(12) United States Patent
Fleischmann et al.

(10) Patent No.: US 6,355,450 B1
(45) Date of Patent: Mar. 12, 2002

(54) **COMPUTER READABLE GENOMIC SEQUENCE OF *HAEMOPHILUS INFLUENZAE* RD, FRAGMENTS THEREOF, AND USES THEREOF**

(75) Inventors: Robert D. Fleischmann, Gaithersburg; Mark D. Adams, N. Potomac; Owen White, Gaithersburg; Hamilton O. Smith, Towson; J. Craig Venter, Potomac, all of MD (US)

(73) Assignee: Human Genome Sciences, Inc., Rockville, MD (US)

( * ) Notice: Subject to any disclaimer, the term of this patent is extended or adjusted under 35 U.S.C. 154(b) by 0 days.

(21) Appl. No.: 08/476,102

(22) Filed: Jun. 7, 1995

Related U.S. Application Data

(63) Continuation-in-part of application No. 08/426,787, filed on Apr. 21, 1995, now abandoned.

(51) Int. Cl.$^7$ .......................... C12P 21/06; C12N 1/20; C12N 15/00; C07H 21/04

(52) U.S. Cl. ................ 435/69.1; 435/252.3; 435/320.1; 435/851; 536/23.1; 536/23.7; 536/24.32; 536/24.33

(58) Field of Search .............................. 536/23.1, 23.7, 536/24.3, 24.32, 24.33; 435/69.1, 320.1, 252.3, 851

(56) References Cited

U.S. PATENT DOCUMENTS

| | | | |
|---|---|---|---|
| 5,064,754 A | 11/1991 | Mills | 435/6 |
| 5,202,231 A | 4/1993 | Drmanac et al. | 435/6 |
| 5,219,726 A | 6/1993 | Evans | 435/6 |
| 5,288,644 A | 2/1994 | Beavis et al. | 436/94 |

FOREIGN PATENT DOCUMENTS

| | | |
|---|---|---|
| CA | 2182046 | 1/1998 |
| EP | 0378929 A2 | 7/1990 |
| WO | 93/12230 | 6/1993 |
| WO | 93/19090 | 9/1993 |
| WO | 94/12641 | 6/1994 |
| WO | 9700697 | 1/1997 |
| WO | 9701638 | 1/1997 |
| WO | 9736914 | 1/1997 |

OTHER PUBLICATIONS

Cope, L. D. et al., "A Gene Cluster Involved in the Utilization of Both Free Heme and Heme:Hemopexin by *Haemophilus influenzae* Type B," *J. Bacteriol.* 177(10):2644–2653 (May 1995).

Cope, L. D. et al., "A Gene Cluster Involved in the Utilization of Both Free Heme and Heme:Hemopexin by *Haemophilus influenzae* type B," nucleotide sequence from Nucleotide Database on ENTREZ Release 15.0, published on CD–ROM by National Center for Biotechnology Information, National Library of Medicine, National Institutes of Health, Bethesda, MD (Feb. 1995).

Fleischmann, R. D. et al., "Whole–Genome Random Sequencing and Assembly of *Haemophilus influenzae* Rd," *Science* 269:496–512 (Jul. 1995).

Sanders, J. D. et al., "Identification of a Locus Involved in the Utilization of Iron by *Haemophilus influenzae*," *Infect. Immun.* 62(10):4515–4525 (Oct. 1994).

Watson, J. D. et al., eds., "Recombinant DNA in Medicine and Industry," in: *Recombinant DNA*, Second Edition, New York: Scientific American Books, W. H. Freeman and Company, pp. 453–470 (1992).

Weiser, J. N. et al., "Identification and characterization of oapA, a cell–envelope protein of *Haemophilus influenzae* contributing to phase variation in colony opacity and nasopharyngeal colonization," nucleotide sequence from Nucleotide Database on ENTREZ Release 15.0, published on CD–ROM by National Center for Biotechnology Information, National Library of Medicine, National Institutes of Health, Bethesda, MD (Feb. 1995).

International Search Report for PCT/US96/05320, mailed Aug. 27, 1996.

Adams et al., "A model for high–throughput automated DNA sequencing and analysis core facilities," *Nature* 368:474–475 (Mar. 31, 1994).

Bankier et al., "The DNA sequence of the human cytomegalovirus genome," *DNA Sequence—J. DNA Sequencing and Mapping* 2:1–12 (1991).

Goebel et al., "The Complete DNA Sequence of Vaccinia Virus," *Virology* 179:247–266 (1990).

Kauc et al., "Size and Physical Map of the Chromosome of *Haemophilus influenzae*," *J Bacteriol.* 171:2474–2479 (1989).

Lee et al., "Organization of the *Haemophilus influenzae* Rd Genome," *J Bacteriol.* 171:3016–3024 (1989).

Lee and Smith, "Sizing of the *Haemophilus influenzae* Rd Genome by Pulsed–Field Agarose Gel Electrophoresis," *J. Bacteriol.* 170(9):4402–4405 (1988).

Levy, J., "Sequencing the Yeast Genome: An International Achievement," *Yeast* 10:1689–1706 (Dec. 1994).

(List continued on next page.)

*Primary Examiner*—Bruce R. Campell

(57) ABSTRACT

The present invention provides the sequencing of the entire genome of *Haemophilus influenzae* Rd, SEQ ID NO: 1. The present invention further provides the sequence information stored on computer readable media, and computer-based systems and methods which facilitate its use. In addition to the entire genomic sequence, the present invention identifies over 1700 protein encoding fragments of the genome and identifies, by position relative to a unique Not I restriction endonuclease site, any regulatory elements which modulate the expression of the protein encoding fragments of the *Haemophilus* genome.

88 Claims, 47 Drawing Sheets

OTHER PUBLICATIONS

Nowak, R., "Genome Research: Venter Wins Sequencing Race–Twice," *Science 268*:1273 (Jun. 2, 1995).

Oda et al., "Gene Organization Deduced from the complete sequence of Liverwort *Marchantia polymorpha* Mitochondrial DNA," *J. Mol. Biol. 223*:1–7 (1992).

Ohyama et al., "Chloroplast gene organization deduced from the complete sequence of liverwort *Marchantia polymorpha* chloroplast DNA," *Nature 322*:572–574 (1986).

Redfield and Lee, "*Haemophilus influenzae* Rd," in Genetic Maps: Locus Maps of Complex Genomes, Fifth Edition, O'Brien, ed. Cold Springs Harbor Laboratory Press, New York, pp. II110–II112 (1990).

Sulston et al., "The *C. elegans* genome sequencing project: a beginning," *Nature 356*:37–41 (1992).

JF Tomb et al (1989) J Bacteriology 171: 3796–3802.

L Kauc et al (Dec. 1989) J Bacteriology 171: 6625–6628.

L Kauc et al (May 1989) J Bacteriology 171: 2474–2479.

RS Munson et al (1993) Infection and Immunity 61:4017–4020.

J Won et al (1993) Infection and Immunity 61: 2813–2821.

J. Weiser et al (1989) Cell 59: 657–665.

R Munson et al (1989) Infection and Immunity 57: 3300–3305.

RA Deich et al (1988) J Bacteriology 170: 489–498.

HAEMOPHILUS INFLUENZAE

COMPUTER READABLE GENOMIC SEQUENCE OF *HAEMOPHILUS INFLUENZAE* RD, FRAGMENTS THEREOF, AND USES THEREOF

CROSS REFERENCE TO RELATED APPLICATIONS

This application is a continuation-in-part of application Ser. No. 08/426,787, filed Apr. 21, 1995, abandoned which is hereby incorporated by reference.

Part of the work performed during development of this invention utilized U.S. Government funds. The government may have certain rights to this invention. NIH-5RO1GM48251.

FIELD OF THE INVENTION

The present invention relates to the field of bioinformatics. The present invention discloses the genomic sequence (the entire life-sustaining instructions and information) of *Haemophilus influenzae* Rd recorded on a computer readable medium, as well as computer-based systems and methods that employ said sequence.

BACKGROUND OF THE INVENTION

The complete genome sequence from a free living cellular organism has never been determined. The first mycobacterium sequence should be completed by 1996, while *E. coli* and *S. cervadase* are expected to be completed before 1998. These are being done by random and/or directed sequencing of overlapping cosmid clones. No one has attempted to determine sequences of the order of a megabase or more by a random shotgun approach.

*H. influenzae* is a small (approximately 0.4×1 micron) non-motile, non-spore forming, germ-negative bacterium whose only natural host is human. It is a resident of the upper respiratory mucosa of children and adults and causes otitis media and respiratory tract infections mostly in children. The most serious complication is meningitis, which produces neurological sequelae in up to 50% of affected children. Six *H. influenzae* serotypes (a through f) have been identified based on immunologically distinct capsular polysaccharide antigens. A number of non-typeable strains are also known. Serotype b accounts for the majority of human disease.

Interest in the medically important aspects of *H. influenzae* biology has focused particularly on those genes which determine virulence characteristics of the organism. A number of the genes responsible for the capsular polysaccharide have been mapped and sequenced (Kroll et al., *Mol. Microbiol*, 5(6):1549–1560 (1991)). Several outer membrane protein (OMP) genes have been identified and sequenced (Langford et al., *J. Gen. Microbiol.* 138:155–159 (1992)). The lipoligosaccharide (LOS) component of the outer membrane and the genes of its synthetic pathway are under intensive study (Weiser et al., *J. Bacteriol.* 172:3304–3309 (1990)). While a vaccine has been available since 1984, the study of outer membrane components is motivated to some extent by the need for improved vaccines. Recently, the catalase gene was characterized and sequenced as a possible virulene-related gene (Bishni et al., in press). Elucidation of the *H. influenzae* genome will enhance the understanding of how *H. influenzae* causes invasive disease and how best to combat infection.

*H. influenzae* possesses a highly efficient natural DNA transformation system which has been intensively studied in the non-encapsulated (R), serotype d strain (Kahn and Smith, *J. Membrane Biology* 81:89–103 (1984)). At least 16 transformation-specific genes have been identified and sequenced. Of these, four are regulatory (Redfield, *J. Bacteriol.* 173:5612–5618 (1991), and Chandler, *Proc. Natl. Acad. Sci. USA* 89:1626–1630 (1992)), at least two are involved in recombination processes (Barouki and Smith, *J. Bacteriol.* 163(2):629–634 (1985)), and at least seven are targeted to the membranes and periplasmic space (Tomb, et al., *Gene* 104:1–10 (1991), and Tomb, *Proc. Natl. Acad. Sci. USA* 89:1025–10256 (1992)), where they appear to function as structural components or in the assembly of the DNA transport machinery. *H. influenzae* Rd transformation shows a number of interesting features including sequence-specific DNA uptake, rapid uptake of several double-stranded DNA molecules per competent cell into a membrane compartment called the transformasome, linear translocation of a single strand of the donor DNA into the cytoplasm, and synapsis and recombination of the strand with the chromosome by a single-strand displacement mechanism. The *H. influenzae* Rd transformation system is the most thoroughly studied of the gram-negative systems and distinct in a number of ways from the gram-positive systems.

The size of *H. influenzae* Rd genome has been determined by pulsed-field agarose gel electrophoresis of restriction digests to be approximately 1.9 Mb, making its genome approximately 40% the size of *E. coli* (Lee and Smith, *J. Bacteriol.* 170:4402–4405 (1988)). The restriction map of *H. influenzae* is circular (Lee et al., *J. Bacteriol.* 171:3016–3024 (1989), and Redfield and Lee, "*Haemophilus influenzae* Rd", pp. 2110–2112, In O'Brien, S. J. (ed), Genetic Maps: Locus Maps of Complex Genomes, Cold Spring Harbor Press, New York). Various genes have been mapped to restriction fragments by Southern hybridization probing of restriction digest DNA bands. This map will be valuable in verification of the assembly of a complete genome sequence from randomly sequenced fragments. GenBank currently contains about 100 kb of non-redundant *H. influenzae* DNA sequences. About half are from serotype b and half from Rd.

SUMMARY OF THE INVENTION

The present invention if based on the sequencing of the *Haemophilus influenzae* Rd genome. The primary nucleotide sequence which was generated is provided in SEQ ID NO: 1.

The present invention provides the generated nucleotide sequence of the *Haemophilus influenzae* Rd genome, or a representative fragment thereof, in a form which can readily used, analyzed, and interpreted by a skilled artisan. In one embodiment, present invention is provided as a contiguous string of primary sequence information corresponding to the nucleotide sequence depicted in SEQ ID NO: 1.

The present invention further provides nucleotide sequences which are at least 99.9% identical to the nucleotide sequence of SEQ ID NO: 1.

The nucleotide sequence of SEQ ID NO: 1, a representative fragment thereof, or a nucleotide sequence which is at least 99.9% identical to the nucleotide sequence of SEQ ID NO: 1 may be provided in a variety of mediums to facilitate its use. In one application of this embodiment, the sequences of the present invention are recorded on computer readable media. Such media includes, but is not limited to: magnetic storage media, such as floppy disc, hard disc storage medium, and magnetic tape; optical storage media such as CD-ROM; electrical storage media such as RAM and ROM; and hybrids of these categories such as magnetic/optical storage media.

The present invention further provides systems, particularly computer-based systems which contain the sequence information herein described stored in a data storage means. Such systems are designed to identify commercially important fragments of the *Haemophilus influenzae* Rd genome.

Another embodiment of the present invention is directed to isolated fragments of the *Haemophilus influenzae* Rd genome. The fragments of the *Haemophilus influenzae* Rd genome of the present invention include, but are not limited to, fragments which encode peptides, hereinafter open reading frames (ORFs), fragments which modulate the expression of an operably linked ORF, hereinafter expression modulating fragments (EMFs), fragments which mediate the uptake of a linked DNA fragment into a cell, hereinafter uptake modulating fragments (UMFs), and fragments which can be used to diagnose the presence of *Haemophilus influenzae* Rd in a sample, hereinafter, diagnostic fragments (DFs).

Each of the ORF fragments of the *Haemophilus influenzae* Rd genome disclosed in Tables 1(a) and 2, and the EMF found 5' to the ORF, can be used in numerous ways as polynucleotide reagents. The sequences can be used as diagnostic probes or diagnostic amplification primers for the presence of a specific microbe in a sample, for the production of commercially important pharmaceutical agents, and to selectively control gene expression.

The present invention further includes recombinant constructs comprising one or more fragments of the *Haemophilus influenzae* Rd genome of the present invention. The recombinant constructs of the present invention comprise vectors, such as a plasmid or viral vector, into which a fragment of the *Haemophilus influenzae* Rd has been inserted.

The present invention further provides host cells containing any one of the isolated fragments of the *Haemophilus influenzae* Rd genome of the present invention. The host cells can be a higher eukaryotic host such as a mammalian cell, a lower eukaryotic cell such as a yeast cell, or can be a procaryotic cell such as a bacterial cell.

The present invention is further directed to isolated proteins encoded by the ORFs of the present invention. A variety of methodologies known in the art can be utilized to obtain any one of the proteins of the present invention. At the simplest level, the amino acid sequence can be synthesized using commercially available peptide synthesizers. In an alternative method, the protein is purified from bacterial cells which naturally produce the protein. Lastly, the proteins of the present invention can alternatively be purified from cells which have been altered express the desired protein.

The invention further provides methods of obtaining homologs of the fragments of the *Haemophilus influenzae* Rd genome of the present invention and homologs of the proteins encoded by the ORFs of the present invention. Specifically, by using the nucleotide and amino acid sequences disclosed herein as a probe or as primers, and techniques such as PCR cloning an colony/plaque hybridization, one skilled in the art can obtain homologs.

The invention further provides antibodies which selectively bind one of the proteins of the present invention. Such antibodies include both monoclonal and polyclonal antibodies.

The invention further provides hybridomas which produce the above-described antibodies. A hybridization is an immortalized cell line which is capable of secreting a specific monoclonal antibody.

The present invention further provides methods of identifying test samples derived from cells which express one of the ORF of the present invention, or homolog thereof. Such methods comprise incubating a test sample with one or more of the antibodies of the present invention, or one or more of the DFs of the present invention, under conditions which allow a skilled artisan to determine if the sample contains the ORF or product produced therefrom.

In another embodiment of the present invention, kits are provided which contain the necessary reagents to carry out the above-described assays.

Specifically, the invention provides a compartmentalized kit to receive, in close confinement, one or more containers which comprises: (a) a first container comprising one of the antibodies, or one of the DFs of the present invention; and (b) one or more other containers comprising one or more of the following: wash reagents, reagents capable of detecting presence of bound antibodies or hybridized DFs.

Using the isolated proteins of the present invention, the present invention further provides methods of obtaining and identifying agents capable of binding to a protein encoded by one of the ORFs of the present invention. Specifically, such agents include antibodies (described above), peptides, carbohydrates, pharmaceutical agents and the like. Such methods comprise the steps of:

(a) contacting an agent with an isolated protein encoded by one of the ORFs of the present invention; and (b) determining whether the agent binds to said protein.

The complete genomic sequence of *H. influenzae* will be of great value to all laboratories working with this organism and for a variety of commercial purposes. Many fragments of the *Haemophilus influenzae* Rd genome will be immediately identified by similarly searches against GenBank or protein databases and will be of immediate value to *Haemophilus* researchers and for immediate commercial value for the production of proteins or to control gene expression. A specific example concerns PHA synthase. It has been reported that polyhydroxybutyrate is present in the membrane of *Haemophilus influenzae* Rd and that the amount correlates with the level of competence for transformation. The PHA synthase that synthesizes this polymer has been identified and sequenced in a number of bacteria, none of which are evolutionarily close to *H. influenzae*. This gene has yet to be isolated from *Influenzae* by use of hybridization probes or PCR techniques. However, the genomic sequence of the present invention allows the identification of the gene by utilizing search means described below.

Developing the methodology and technology for elucidating the entire genomic sequence of bacterial and other small genomes has and will greatly enhance the ability to analyze and understand chromosomal organization. In particular, sequenced genomes will provide the models for developing tools for the analysis of chromosome structure and function, including the ability to identify genes within large segments of genomic DNA, the structure, position, and spacing of regulatory elements, the identification of genes with potential industrial applications, and the ability to do comparative genomic and molecular phylogeny.

DETAILED DESCRIPTION OF THE PREFERRED EMBODIMENTS

Figure 1:
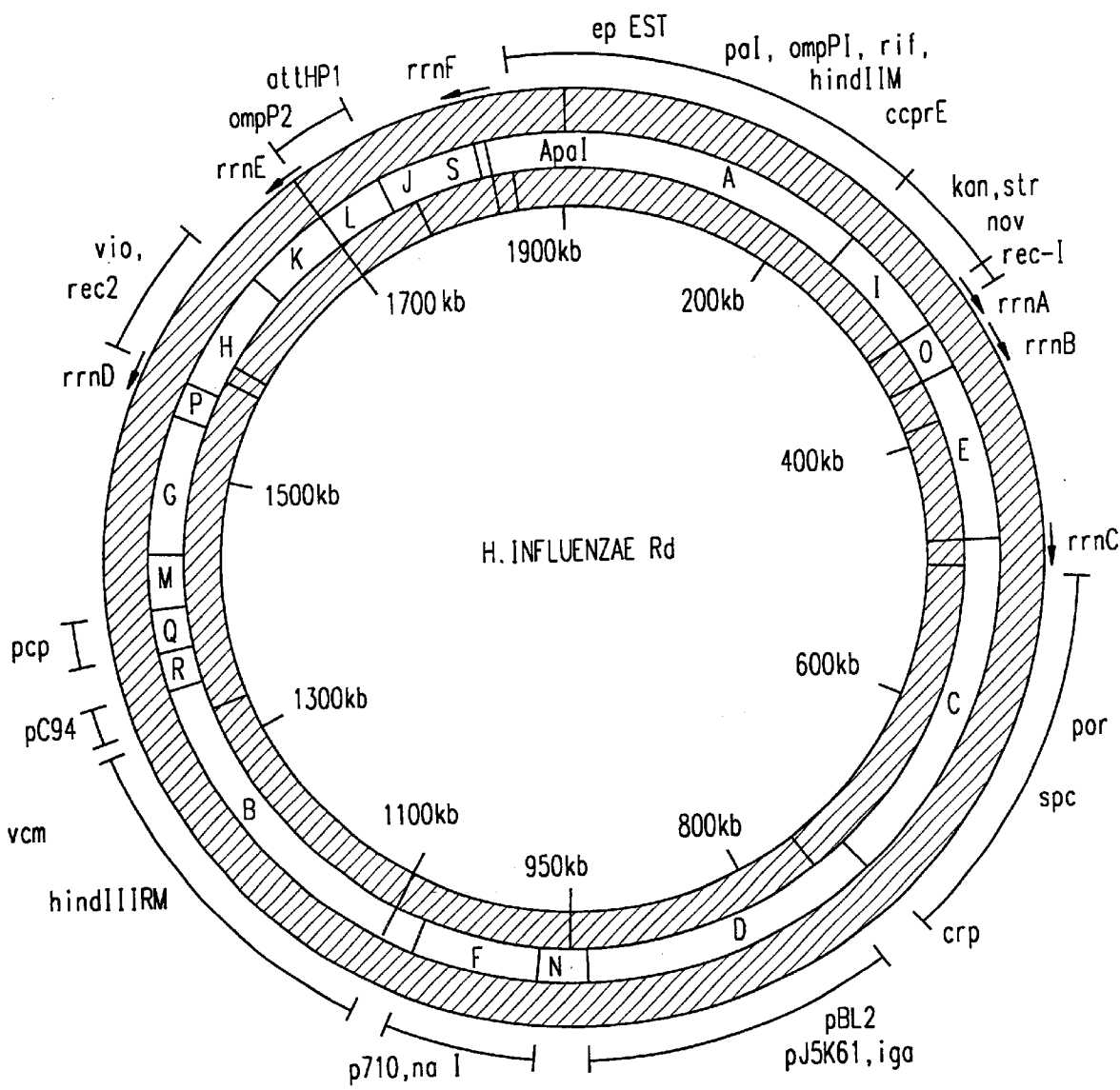
FIG. 1—restriction map of the *Haemophilus influenzae* Rd genome.

The present invention is based on the sequencing of the *H. influenzae* Rd genome. The primary nucleotide sequence which was generated is provided in SEQ ID NO: 1. As used herein, the "primary sequence" refers to the nucleotide sequence represented by the IUPAC nomenclature system.

The sequence provided in SEQ ID NO: 1 is oriented relative to a unique Not I restriction endonuclease site found in the *H. influenzae* Rd genome. A skilled artisan will readily recognize that this start/stop point was chosen for convenience and does not reflect a structural significance.

The present invention provides the nucleotide sequence of SEQ ID NO: 1, or a representative fragment thereof, in a form which can be readily used, analyzed, and interpreted by a skilled artisan. In one embodiment, the sequence is provided as a contiguous string of primary sequence information corresponding to the nucleotide sequence provided in SEQ ID NO: 1.

As used herein, a "representative fragment of the nucleotide sequence depicted in SEQ ID NO: 1" refers to any portion of SEQ ID NO: 1 which is not presently represented within a publicly available database. Preferred representative fragments of the present invention are *Haemophilus influenzae* open reading frames, expression modulating fragments, uptake modulating fragments, and fragments which can be used to diagnose the presence of *Haemophilus influenzae* Rd in sample. A non-limiting identification of such preferred representative fragments is provided in Tables 1(*a*) and and 2.

The nucleotide sequence information provided in SEQ ID NO: 1 was obtained by sequencing the *Haemophilus influenzae* Rd genome using a megabase shotgun sequencing method. Using three parameters of accuracy discussed in the Examples below, the present inventors have calculated that the sequence in SEQ ID NO: 1 has a maximum accuracy of 99.98%. Thus, the nucleotide sequence provided in SEQ ID NO: 1 is a highly accurate, although not necessarily a 100% perfect, representation of the nucleotide sequence of the *Haemophilus influenzae* Rd genome.

As discussed in detail below, using the information provided in SEQ ID NO: 1 and in Tables 1(a) and 2 together with routine cloning and sequencing methods, one of ordinary skill in the art will be able to clone and sequence all "representative fragments" of interest including open reading frames (ORFs) encoding a large variety of *Haemophilus influenzae* proteins. In very rare instances, this may reveal a nucleotide sequence error present in the nucleotide sequence disclosed in SEQ ID NO: 1. Thus, once the present invention is made available (i.e., once the information in SEQ ID NO: 1 and Tables 1(a) and 2 have been made available), resolving a rare sequencing error in SEQ ID NO: 1 will be well within the skill of the art. Nucleotide sequence editing software is publicly available. For example, Applied Biosystem's (AB) AutoAssembler™ can be used as an aid during visual inspection of nucleotide sequences.

Even if all of the very rare sequencing errors in SEQ ID NO: 1 were corrected, the resulting nucleotide sequence would still be at least 99.9% identical to the nucleotide sequence in SEQ ID NO: 1.

The nucleotide sequences of the genomes from different strains of *Haemophilus influenzae* differ slightly. However, the nucleotide sequence of the genomes of all *Haemophilus influenzae* strains will be at least 99.9% identical to the nucleotide sequence provided in SEQ ID NO: 1.

Thus, the present invention further provides nucleotide sequences which are at least 99.9% identical to the nucleotide sequence of SEQ ID NO: 1 in a form which can be readily used, analyzed and interpreted by the skilled artisan. Methods for determining whether a nucleotide sequence is at least 99.9% identical to the nucleotide sequence of SEQ ID NO: 1 are routine and readily available to the skilled artisan. For example, the well known fasts algorithm (Pearson and Lipman, *Proc. Natl. Acad. Sci. USA* 85:2444 (1988)) can be used to generate the percent identity of nucleotide sequences.

Computer Related Embodiments

The nucleotide sequence provided in SEQ ID NO: 1, a representative fragment thereof, or a nucleotide sequence at least 99.9% identical to SEQ ID NO: 1 may be "provided" in a variety of mediums to facilitate use thereof. As used herein, provided refers to a manufacture, other than an isolated nucleic acid molecule, which contains a nucleotide sequence of the present invention, i.e., the nucleotide sequence provided in SEQ ID NO: 1, a representative fragment thereof, of a nucleotide sequence at least 99.9% identical to SEQ ID NO: 1. Such a manufacture provides the *Haemophilus influenzae* Rd genome or a subset thereof (e.g., a *Haemophilus influenzae* Rd open reading frame (ORF)) in a form which allows a skilled artisan to examine the manufacture using means not directly applicable to examining the *Haemophilus influenzae* Rd genome or a subset thereof as it exists in nature or in purified form.

In one application of this embodiment, a nucleotide sequence of the present invention can be recorded on computer readable media. As used herein, "computer readable media" refers to any medium which can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and MicroSoft Word, or represented in the form of an ASCH file, stored in a database application, such as DB2, Sybase, Oracle, or the like. A skilled artisan can readily adapt any number of dataprocessor structuring formats (e.g. text file or database) in order to obtain computer readable medium having recorded thereon the nucleotide sequence information of the present invention.

By providing the nucleotide sequence of SEQ ID NO: 1, a representative fragment thereof, or a nucleotide sequence at least 99.9% identical to SEQ ID NO: 1 in computer readable form, a skilled artisan can routinely access the sequence information for a variety of purposes. Computer software is publicly available which allows a skilled artisan to access sequence information provided in a computer readable medium. The examples which follow demonstrate how software which implements the BLAST (Altaschul et al., *J. Mol. Biol.* 215:403–410 (1990)) and BLAZE (Brutlag et al., *Comp. Chem.* 17:203–207 (1993)) search algorithms on a Sybase system was used to identify open reading frames (ORFs) within the *Haemophilus influenzae* Rd genome which contain homology to ORFs or proteins from other organisms. Such ORFs are protein encoding fragments within the *Haemophilus influenzae* Rd genome and are useful in producing commercially important proteins such as enzymes and in fermentation sections and in the production of commercially useful metabolites.

The present invention further provides systems, particularly computer-based systems, which consists the sequence information described herein. Such systems are designed to identify commercially important fragments of the *Haemophilus influenzae* Rd genome.

As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As stated above, the computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *Haemophilus influenzae* Rd genome which match a particular target sequence or target motif. A variety of known algorithms are disclosed publicly and a variety of commercially available software for conducting search means are and can be used in the computer-based systems of the present invention. Examples of such software includes, but is not limited to, MacPattern (EMBL), BLASTN and BLASTX (NCBIA). A skilled artisan can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A skilled artisan can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that searches for commercially important fragments of the *Haemophilus influenzae* Rd genome, such as sequence fragments involved in gene expression and protein processing, may be of shorter length.

As used herein, "a target structural motif," or "target motif," refers to any rationally selected sequence or combination of sequences in which the sequence(s) are chosen based on a three-dimensional configuration which is formed upon the folding of the target motif. There are a variety of target motifs known in the art. Protein target motifs include, but are not limited to, enzymic active sites and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *Haemophilus influenzae* Rd genome possessing varying degrees of homology to the target sequence or target motif. Such presentation provides skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments of the *Haemophilus influenzae* Rd genome. In the present examples, implementing software which implement the BLAST and BLAZE algorithms (Altschul et al., *J. Mol. Biol.* 215:403–410 (1990)) was used to identify open reading frames within the *Haemophilus influenzae* Rd genome. A skilled artisan can readily recognize that any one of the publicly available homology search programs can be used as the search means for the computer-based systems of the present invention.

Figure 2:
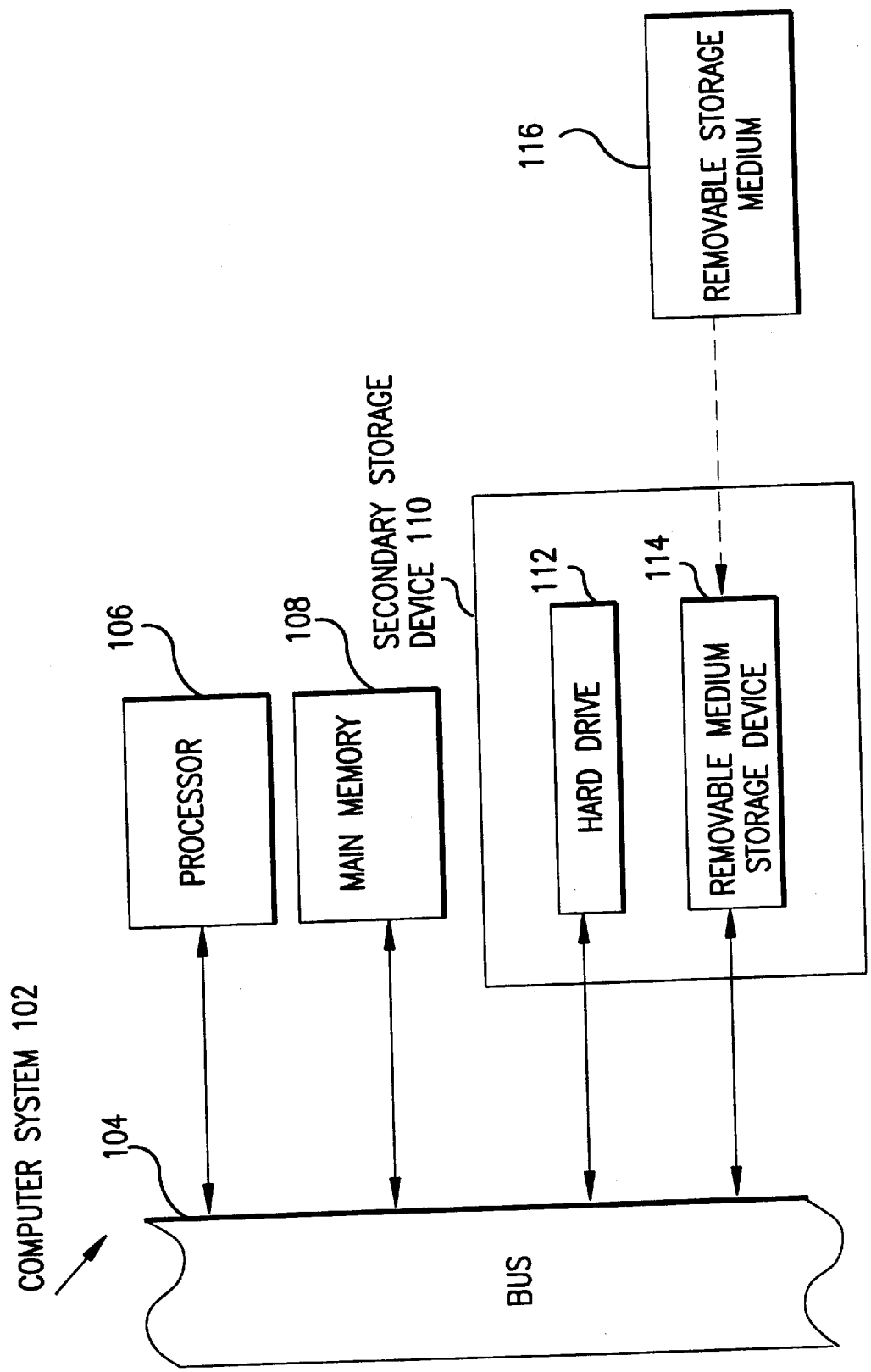
FIG. 2—Block diagram of a computer system 102 that can be used to implement the computer-based systems of present invention.

One application of this embodiment is provided in FIG. 2. FIG. 2 provides a block diagram of a computer system 102 that can be used to implement the present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, and magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable medium storage device 114 once inserted in the removable medium storage device 114.

A nucleotide sequence of the present invention may be stored in a well known manner in the main memory 108, any of the secondary storage device 110, and/or a removable storage medium 116. Software for accessing and processing the genomic sequence (such as search tools, comparing tools, etc.) reside in main memory 108 during execution.

Biochemical Embodiments

Another embodiment of the present invention is directed to isolated fragments of the *Haemophilus influenzae* Rd genome. The fragments of the *Haemophilus influenzae* Rd genome of the present invention include, but are not limited to fragments which encode peptides, hereinafter open reading frames (ORFs), fragments which modulate the expression of an operably linked ORF, hereinafter expression modulating fragments (EMFs), fragments which mediate the uptake of a linked DNA fragment into a cell, hereinafter uptake modulating fragments (UMFs), and fragments which can be used to diagnose the presence of *Haemophilus influenzae* Rd in a sample, hereinafter diagnostic fragments (DFs).

As used herein, an "isolated nucleic acid molecule" or an "isolated fragment of the *Haemophilus influenzae* Rd genome" refers to a nucleic acid molecule possessing a specific nucleotide sequence which has been subjected to purification means to reduce, from the composition, the number of compounds which are normally associated with the composition. A variety of purification means can be used to generated the isolated fragments of the present invention. These include, but are not limited to methods which separate constituents of a solution based on charge, solubility, or size.

In one embodiment, *Haemophilus influenzae* Rd DNA can be mechanically sheared to produce fragments of 15–20 kb in length. These fragments can then be used to generate an *Haemophilus influenzae* Rd library by inserting them into labda clones as described in the Examples below. Primers flanking, for example, an ORF provided in Table 1(a) can then be generated using nucleotide sequence information provided in SEQ ID NO:1. PCR cloning can then be used to isolate the ORF from the lambda DNA library. PCR cloning is well known in the art. Thus, given the availability of SEQ ID NO:1, Table 1(a) and Table 2, it would be routine to isolate any ORF or other nucleic acid fragment of the present invention.

The isolated nucleic acid molecules of the present invention include, but are not limited to single stranded and double stranded DNA, and single stranded RNA.

As used herein, an "open reading frame," ORF, means a series of triplets coding for amino acids without any termination codons and is a sequence translatable into protein. Tables 1a, 1b and 2 identify ORFs in the *Haemophilus influenzae* Rd genome. In particular, Table 1a indicates the location of ORFs within the *Haemophilus influenzae* genome which encode the recited protein based on homology matching with protein sequences from the organism appearing in parentheticals (see the fourth column of Table 1(a)).

The first column of Table 1(a) provides the "GeneID" of a particular ORF. This information is useful for two reasons. First, the complete map of the *Haemophilus influenzae* Rd genome provided in FIGS. 6A–6N refers to the ORFs according to their geneID numbers. Second, Table 1(b) uses the GeneID numbers to indicate which ORFs were provided previously in a public database.

The second and third columns in Table 1(a) indicate an ORFs position in the nucleotide sequence provided in SEQ ID NO:1. One of ordinary skill will recognize that ORFs may be oriented in opposite directions in the *Haemophilus influenzae* genome. This is reflected in columns 2 and 3.

The fifth column of Table 1(a) indicates the percent identity of the protein encoded for by an ORF to the corresponding protein from the organism appearing in parentheticals in the fourth columns.

The sixth column of Table 1(a) indicates the percent similarity of the protein encoded for by an ORF to the corresponding protein from the organism appearing in parentheticals in the fourth column. The concepts of percent identity and percent similarity of two polypeptide sequences is well understood in the art. For example, two polypeptides 10 amino acids in length which differ at three amino acid positions (e.g., at positions 1, 3 and 5) are said to have a percent identity of 70%. However, the name two polypeptides would be deemed to have a percent similarity of 80% if, for example at position 5, the amino acids moieties, although not identical, were "similar" (i.e., possessed similar biochemical characteristics).

The seventh column in Table 1(a) indicates the length of the amino acid homology match.

Table 2 provides ORFs of the *Haemophilus influenzae* Rd genome which encode polypeptide sequences which did not elicit a "homology match" with a known protein sequence from another organism. Further details concerning the algorithms and criteria used for homology searches are provided in the Examples below.

A skilled artisan can readily identify ORFs in the *Haemophilus influenzae* Rd genome other than those listed in Tables 1(a), 1(b) and 2, such as ORFs which are overlapping or encoded by the opposite strand of an identified ORF in addition to those ascertainable using the computer-based systems of the present invention.

As used herein, an "expression modulating fragment," EMF, means a series of nucleotide molecules which modulates the expression of an operably linked ORF or EMF.

As used herein, a sequence is said to "modulate the expression of an operably linked sequence" when the expression of the sequence is altered by the presence of the EMF. EMFs include, but are not limited to, promoters, and promoter modulating sequences (inducible elements). One class of EMFs are fragments which induce the expression or an operably linked ORF in response to a specific regulatory factor or physiological event. A review of known EMFs from Haemophilus are described by (Tomb et al. *Gene* 104:1–10 (1991), Chandler, M. S., *Proc. Natl. Acad. Sci. USA* 89:1626–1630 (1992).

EMF sequences can be identified within the *Haemophilus influenzae* Rd genome by their proximity to the ORFs provided in Tables 1(a), 1(b) and 2. An intergenic segment, or a fragment of the intergenic segment, from about 10 to 200 nucleotides is length, taken 5' from any one of the ORFs of Tables 1(a), 1(b), or 2 will modulate the expression of an operably linked 3' ORF in a fashion similar to that found with the naturally linked ORF sequence. As used herein, an "intergenic segment" refers to the fragments of the Haemophilus genome which are between two ORF(s) herein described. Alternatively, EMFs can be identified using known EMFs as a target sequence or target motif in the computer-based systems of the present invention.

The presence and activity of an EMF can be confirmed using an EMF trap vector. An EMF trap vector contains a cloning site 5' to a marker sequence. A marker sequence encodes an identifiable phenotype, such as antibiotic resistance or a complementing nutrition auxotrophic factor, which can be identified or assayed when the EMF trap vector is placed within an appropriate host under appropriate conditions. As described above, a EMF will modulate the expression of an operably linked marker sequence. A more detailed discussion of various marker sequences is provided below.

A sequence which is suspected as being a EMF is cloned in all three reading frames in one or more restriction sites upstream from the marker sequence in the EMF trap vector. The vector is then transformed into an appropriate host using known procedures and the phenotype of the transformed host in examined under appropriate conditions. As described above, as EMF will modulate the expression of an operably linked marker sequence.

As used herein, an "uptake modulating fragment," UMF, means a series of nucleotide molecules which mediate the uptake of a linked DNA fragment into a cell. UMFs can be readily identified using known UMFs as a target sequence or target motif with the computer-based systems described above.

The presence and activity of a UMF can be confirmed by attaching the suspected UMF to a marker sequence. The resulting nucleic acid molecule is then incubated with an appropriate host under appropriate conditions and the uptake of the marker sequence is determined. As described above, a UMF will increase the frequency of uptake of a linked marker sequence. A review of DNA uptake in Haemophilus is provided by Goodgall, S. H., et al., *J. Bact.* 172:5924–5928 (1990).

As used herein, a "diagnostic fragment," DF, means a series of nucleotide molecules which selectively hybridize to *Haemophilus influenzae* sequences. DFs can be readily identified by identifying unique sequences within the *Haemophilus influenzae* Rd genome, or by generating and testing probes or amplification primers consisting of the DF sequence in an appropriate diagnostic format which determines amplification or hybridization selectivity.

The sequences falling within the scope of the present invention are not limited to the specific sequences herein described, but also include allelic and species variations thereof. Allelic and species variations can be routinely determined by comparing the sequence provided in SEQ ID NO:1, a representative fragment thereof, or a nucleotide sequence at least 99.9% identical to SEQ ID NO:1 with a sequence from another isolate of the same species. Furthermore, to accommodate codon variability, the invention includes nucleic acid molecules coding for the same amino acid sequences as do the specific ORFs disclosed herein. In other words, in the coding region of an ORF, substitution of one codon for another which encodes the same amino acid is expressly contemplated.

Any specific sequence disclosed herein can be readily screened for errors by resequencing a particular fragment, such as an ORF, in both directions (i.e., sequence both strands). Alternatively, error screening can be performed by sequencing corresponding polynucleotides of *Haemophilus influenzae* origin isolated by using part or all of the fragments in question as a probe or primer.

Each of the ORFs of the *Haemophilus influenzae* Rd genome disclosed in Tables 1(a), 1(b), and 2, and the EMF found 5' to the ORF, can be used in numerous ways as polynucleotide reagents. The sequences can be used as diagnostic probes or diagnostic amplification primers to detect the presence of a specific microbe, such as *Haemophilus influenzae* RD, in a sample. This is especially the case with the fragments or ORFs of Table 2, which will be highly selective for *Haemophilus influenzae*.

In addition, the fragments of the present invention, as broadly described, can be used to control gene expression through triple helix formation or antisense DNA or RNA, both of which methods are based on the binding of a polynucleotide sequence to DNA or RNA. Polynucleotides suitable for use in these methods are usually 20 to 40 bases in length and are designed to be complementary to a region of the gene involved in transcription (triple helix—see Lee et al., *Nucl. Acids Res.* 6:3073 (1979); Cooney et al., *Science* 241:456 (1988); and Dervan et al., *Science* 251:1360 (1991)) or to the mRNA itself (antisense—Okano, *J. Neurochem,* 56:560 (1991); *Oligodeoxynucleotides as Antisense Inhibitors of Gene Expression*, CRC Press, Boca Raton, Fla. (1988)). Triple helix-formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention is necessary for the design of an antisense or triple helix oligonucleotide.

The present invention further provides recombinant constructs comprising one or more fragments of the *Haemophilus influenzae* Rd genome of the present invention. The recombinant constructs of the present invention comprise a vector, such as a plasmid or viral vector, into which a fragment of the *Haemophilus influenzae* Rd has been inserted, in a forward or reverse orientation. In the case of a vector comprising one of the ORFs of the present invention, the vector may further comprise regulatory sequences, including for example, a promoter, operably linked to the ORF. For vectors comprising the EMFs and UMFs of the present invention, the vector may further comprise a marker sequence or heterologous ORF operably linked to the EMF or UMF. Large numbers of suitable vectors and promoters are known to those of skill in the art and are commercially available for generating the recombinant constructs of the present invention. The following vectors are provided by way of example. Bacterial: pBs, phagescript, PsiX174, pBluescript SK, pBsKS, NH8a, pNH16a, pNH18a, pNH46a (Stratagene); pTrc99A, pKK223-3, pKK233-3, pDR540, pRIT5 (Pharmacia). Eukaryotic: pWLneo, pSV2cat, pOG44, pXT1, pSG (Stratagene) pSVK3, pBPV, pMSG, pSVL (Pharmacia).

Promoter regions can be selected from any desired gene using CAT (chloramphenicol transferase) vectors or other vectors with selectable markers. Two appropriate vectors are pKK232-8 and pCM7. Particular named bacterial promoters include tacl, lacZ, T3, T7, gpt, lambda $P_R$, and trc. Eukaryotic promoters include CMV immediate early, HSV thymidine kinase, early and late SV40, LTRs from retrovirus, and mouse metallothionein-1. Selection of the appropriate vector and promoter is well within the level or ordinary skill in the art.

The present invention further provides host cells containing any one of the isolated fragments of the *Haemophilus influenzae* Rd genome of the present invention, wherein the fragment has been introduced into the host-cell using known transformulation methods. The host cell can be a high eukaryotic host cell, such as a mammalian cell, a lower eukaryotic host cell, such as a yeast cell, or the host cell can be a procaryotic cell, such as a bacterial cell. Introduction of the recombinant construct into the host cell can be effected by calcium phosphate transfection, DEAE, dextran mediated transfection, or electroporation (Davis, L. et al., *Basic Method sin Molecular Biology* (1986)).

The host cells containing one of the fragments of the *Haemophilus influenzae* Rd genome of the present invention, can be used in conventional manners to produce the gene product encoded by the isolated fragment (in the case of an ORF) or can be used to produce a heterologous protein under the control of the EMF.

The present invention further provides isolated polypeptides encoded by the nucleic acid fragments of the present invention or by degenerate variants of the nucleic acid fragments of the present invention. By "degenerate variant" is intended nucleotide fragments which differ from a nucleic acid fragments of the present invention (e.g., an ORF) by nucleotide sequence but, due to the degeneracy of the Genetic Code, encode an identical polypeptide sequence. Preferred nucleic acid fragments of the present invention are the ORFs depicted in Table 1(a) which encode proteins.

A variety of methodologies known in the art can be utilized to obtain any one of the isolated polypeptides or proteins of the present invention. At the simplest level, the amino acid sequence can be synthesized using commercially available peptide synthesizers. This is particularly useful in producing small peptides and fragments of larger polypeptides. Fragments are useful, for example, in generating antibodies against the native polypeptide. In an alternative method, the polypeptide or protein is purified from bacterial cells which naturally produce the polypeptide or protein. One skilled in the art can readily follow known methods for isolating polypeptides and proteins in order to obtain one of the isolated polypeptides or proteins of the present invention. These include, but are not limited to, immunochromatography, HPLC, size-exclusion chromatography, ion-exchange chromatography, and immuno-affinity chromatography.

The polypeptides and proteins of the present invention can alternatively be purified from cells which have been altered to express the desired polypeptide or protein. As used herein, a cell is said to be altered to express a desired polypeptide or protein when the cell, through genetic manipulation, is made to produce a polypeptide or protein which it normally does not produce or which the cell normally produces at a lower level. One skilled in the art can readily adapt procedures for introducing and expressing either recombinant or synthetic sequences into eukaryotic or prokaryotic cells in order to generate a cell which produces one of the polypeptides or proteins of the present invention.

Any host/vector system can be used to express one or more of the ORFs of the present invention. These include, but are not limited to, eukaryotic hosts such as HeLa cells, Cv-1 cell, COS cells, and Sf9 cells, as well as prokaryotic host such as *E. coli* and *B. subtilis*. The most preferred cells are those which do not normally express the particular polypeptide or protein or which expresses the polypeptide or protein at low natural level.

"Recombinant," as used herein, means that a polypeptide or protein is derived from recombinat (e.g., microbial or mammalian) expression systems. "Microbial" refers to recombinant polypeptides or proteins made in bacterial or fungal (e.g., yeast) expression systems. As a product, "recombinant microbial" defines a polypeptide or protein essentially free of native endogenous substances and unaccompanied by associated native glycosylation. Polypeptides or proteins expressed in most bacterial cultures, e.g., *E. coli*, will be free of glycosylation modifications; polypeptides or proteins expressed in yeast will have a glycosylation pattern different from the expressed in mammalian cells.

"Nucleotide sequence" refers to a heteropolymer of deoxyribonucleotides. Generally, DNA segments encoding the polypeptides and proteins provided by this invention are assembled from fragments of the *Haemophilus influenzae*

Rd genome and short oligonucleotide linkers, or from a series of oligonucleotides, to provide a synthetic gene which is capable of being expressed in a recombinant transcriptional unit comprising regulatory elements derived from a microbial or viral operon.

"Recombinant expression vehicle or vector" refers to a plasmid or phage or virus or vector, for expressing a polypeptide from a DNA (RNA) sequence. The expression vehicle can comprise a transcriptional unit comprising an assembly of (1) a genetic element or elements having a regulatory role in gene expression, for example, promoters or enhancers, (2) a structural or coding sequence which is transcribed into mRNA and translated into protein, and (3) appropriate transcription initiation and termination sequences. Structural units intended for use in yeast or eukaryotic expression systems preferably include a leader sequence enabling extracellular secretion of translated protein by a host cell. Alternatively, where recombinant protein is expressed without a leader or transport sequence, it may include an N-terminal methionine residue. This residue may or may not be subsequently cleaved from the expressed recombinant protein to provide a final product.

"Recombinant expression system" means host cells which have stably integrated a recombinant transcriptional unit into chromosomal DNA or carry the recombinant transcriptional unit extra chromosomally. The cells can be prokaryotic or eukaryotic. Recombinant expression systems as defined herein will express heterologous polypeptides or proteins upon induction of the regulatory elements linked to the DNA segment or synthetic gene to be express.

Mature proteins can be expressed in mammalian cells, yeast, bacteria, or other cells under the control of appropriate promoters. Cell-free translation systems can also be employed to produce such proteins using RNAs derived from the DNA constructs of the present invention. Appropriate cloning and expression vectors for use with prokaryatic and eukaryotic hosts are described by Sambrook, et al., in *Molecular Cloning: A Laboratory Manual*, Second Edition, Cold Spring Harbor, New York (1989), the disclosure of which is hereby incorporated by reference.

Generally, recombinant expression vectors will include origins of replication and selectable markers permitting transformation of the host cell, e.g., the ampicillin resistance gene of *E. coli* and *S. cerevisiae* TRP1 gene, and a promoter derived from a high-expressed gene to direct transcription of a downstream structural sequence. Such promoters can be derived from operons encoding glycolytic enzymes such as 3-phosphoglycerate kinase (PGK), a-factor, acid phosphatase, or heat shock proteins, among others. The heterologous structural sequence is assembled din appropriate phase with translation initiation and termination sequences, and preferably, a leader sequence capable of directing secretion of translated protein into the periplasmic space or extracellular medium. Optionally, the heterologous sequence can encode a fusion protein including an N-terminal identification peptide imparting desired characteristics, e.g., stabilization or simplified purification of expressed recombination product.

Useful expression vectors for bacterial use are constructed by inserting a structural DNA sequence encoding a desired protein together with suitable translation imitation and termination signals in operable reading phase with a functional promoter. The vector will comprise one or more phenotypic selectable markers and an origin of replication to ensure maintenance of the vector and to, if desirable, provide amplification within the host. Suitable prokaryotic hosts for transformation include *E. coli, Bacillus subtilis, Salmonella typhimurium* and various species within the genera Pseudomonas, Streptomyces, and Staphylococcus, although others may, also be employed as a matter of choice.

As a representative but nonlimiting example, useful expression vectors for bacterial use can comprise a selectable marker and bacterial origin of replication derived from commercially available plasmids comprising genetic elements of the well known cloning vector pBR322 (ATCC 37017). Such commercial vectors include, for example, pKK223-3 (Pharmacia Fine Chemicals, Uppsala, Sweden) and GEM 1 (Promega Biotec, Madison, Wis., USA). These pBR322 "backbone" sections are combined with an appropriate promoter and the structural sequence to be expressed.

Following transformation of a suitable host strain and growth of the host strain to an appropriate cell density, the selected promoter is derepressed by appropriate means (e.g., temperature shift or chemical induction) and cells are cultured for an additional period. Cells are typically harvested by centrifugation, disrupted by physical or chemical means, and the resulting crude extract retained for further purification.

Various mammalian cell culture systems can also be employed to express recombinant protein. Examples of mammalian expression systems include the COS-7 lines of monkey kidney fibroblasts, described by Gluzman, *Cell* 23:175 (1981), and other cell lines capable of expressing a compatible vector, for example, the C127, 3T3, CHO, HeLa and BHK cell lines. Mammalian expression vectors will comprise an origin of replication, a suitable promoter and enhancer, and also any accessory ribosome binding sites, polyadenylation site, splice donor and acceptor sites, transcriptional terminal sequences, and 5' flanking nontranscribed sequences. DNA sequences derived from the SV40 viral genome, for example, SV40 origin, early promoter, enhancer, splice, and polyadenylation sites may be used to provide the required nontranscribed genetic elements.

Recombinant polypeptides and proteins produced in bacterial culture is usually isolated by initial extraction from cell pellets, followed by one or more salting-out, aqueous ion exchange or size exclusion chromatography steps. Protein refolding steps can be used, as necessary, in completing configuration of the mature protein. Finally, high performance liquid chromatography (HPLC) can be employed for final purification steps. Microbial cells employed in expression of proteins can be disrupted by any convenient method, including freeze-thaw cycling, sonication, mechanical disruption, or use of cell lysing agents.

The present invention further includes isolated polypeptides, proteins and nucleic acid molecules which are substantially equivalent to those herein described. As used herein, substantially equivalent can refer both to nucleic acid and amino acid sequences, for example a mutant sequence, that varies from a reference sequence by one or more substitutions, deletions, or additions, the net effect of which does not result in an adverse functional dissimilarity between reference and subject sequences. For purposes of the present invention, sequences having equivalent biological activity, and equivalent expression characteristics are considered substantially equivalent. For purposes of determining equivalence, truncation of the mature sequence should be disregarded.

The invention further provides methods of obtaining homologs from other strains of *Haemophilus influenzae*, of the fragments of the *Haemophilus influenzae* Rd genome of the present invention and homologs of the proteins encoded by the ORFs of the present invention. As used herein, a sequence or protein of *Haemophilus influenzae* is defined as a homolog of a fragment of the *Haemophilus Influenzae* Rd genome or a protein encoded by one of the ORFs of the present invention, if it share significant homology to one of the fragments of the *Haemophilus influenzae* Rd genome of the present invention or a protein encoded by one of the ORFs of the present invention. Specifically, by using the sequence disclosed herein as a probe or as primers, and techniques such as PCR cloning and colony/plaque hybridization, one skilled in the art can obtain homologs.

As used herein, two nucleic acid molecules or proteins are said to "share significant homology" if the two contain regions which process greater than 85% sequence (amino acid or nucleic acid) homology.

Region specific primers or probes derived from the nucleotide sequence provided in SEQ ID NO:1 or from a nucleotide sequence at last 99.9% identical to SEQ ID NO:1 can be used to prime DNA synthesis and PCR amplification, as well as to identify colonies containing closed DNA encoding a homolog using known methods (Innis et al., *PCR Protocols*, Academic Press, San Diego, Calif. (1990).

When using primers derived from SEQ ID NO:1 or from a nucleotide sequence at least 99.9% identical to SEQ ID NO:1, one skilled in the art will recognize that by employing high stringency conditions (e.g., annealing at 50–60° C.) only sequences which are greater than 75% homologous to the primer will be amplified. By employing lower stringency conditions (e.g., annealing at 35–37° C.), sequences which are greater than 40–50% homologous to the primer will also be amplified.

When using DNA probes derived from SEQ ID NO:1 or from a nucleotide sequence at least 99.9% identical to SEQ ID NO:1 for colony/plaque hybridization, one skilled in the art will recognize that by employing high stringency conditions (e.g., hybridizing at 50–60° C. in 5× SSPC and 50% formamide, and washing at 50–65° C. in 0.5× SSPC), sequences having regions which are greater than 90% homologous to the probe can be obtained, and that by employing lower stringency conditions (e.g., hybridizing at 35–37° C. in 5× SSPC and 40–45% formamide, and washing at 42° C. in SSPC), sequences having regions which are greater than 35–45% homologous to the probe will be obtained.

Any organism can be used as the source for homologs of the present invention so long as the organism naturally expresses such a protein or contains gene encoding the name. The most preferred organism for isolating homologs are bacterias which are closely related to *Haemophilus influenzae* Rd.

Uses for the Compositions of the Invention

Each ORF provided in Table 1(a) was assigned to one of 102 biological role categories adapted from Riley, M., *Mircobiology Reviews* 57(4):862 (1993)). This allows the skilled artisan to determine a use for each identified coding sequence. Tables 1(a) further provides an identification of the type of polypeptide which is encoded for by each ORF. As a result, one skilled in the art can use the polypeptides of the present invention for commercial, therapeutic and industrial purposes consistent with the type of putative identification of the polypeptide.

Such identifications permit one skilled in the art to use the *Haemophilus Influenzae* ORF's in a manner similar to the known type of sequences for which the identification is made; for example, to ferment a particular sugar source or to produce a particular metabolite. (For a review of enzymes used within the commercial industry, see *Biochemical Engineering and Biotechnology Handbook* 2nd, eds. Macmillan Publ. Ltd., NY (1991) and Biocatalysts in Organic Synthesis, ed. J. Tramper et al., Elsevier Science Publishers, Amsterdam, The Netherlands (1985)).

1. Biosynthetic Enzymes

Open reading frames encoding proteins involved in mediating the catalytic reactions involved in intermediary and macromolecular metabolism, the biosynthesis of small molecules, cellular processes and other functions includes enzymes involved in the degradation of the intermediary products of metabolism, enzymes involved in central intermediary metabolism, enzymes involved in respiration, both aerobic and anaerobic, enzymes involved in fermentation, enzymes involved in ATP proton motor force conversion, enzymes involved in broad regulatory function, enzymes involved in amino acid synthesis, enzymes involved in nucleotide synthesis, enzymes involved in cofactor and vitamin synthesis, can be used for industrial biosynthesis. The various metabolic pathways present in *Haemophilus* can be identified based on absolute nutritional requirements as well as by examining the various enzymes identified in Table 1(a).

Identified within the category of intermediary metabolism, a number of the proteins encoded by the identified ORF's in Tables 1(a) are particularly involved in the degradation of intermediary metabolites as well as non-macromolecular metabolism. Some of the enzymes identified include amylases, glucose oxidases, and catalase.

Proteolytic enzymes are another class of commercially important enzymes. Proteolytic enzymes find use in a number of industrial processes including the processing of flax and other vegetable fibers, in the extraction, clarification and depectinization of fruit juices, in the extraction of vegetables' oil and in the maceration of fruits and vegetables to give unicellular fruits. A detailed review of the proteolytic enzymes used in the food industry is provided by Rombouts et al., *Symbiosis* 21:79 (1986) and Voragen et al. in *Biocatalyst in Agricultural Biotechnology*, edited J. R. Whitaker et al., *American Chemical Society Symposium Series* 389:93 (1989)).

The metabolism of glucose, galactose, fructose, and xylose are important parts of the primary metabolism of *Haemophilus*. Enzymes involved in the degradation of these sugars can be used in industrial fermentation. Some of the important sugar transforming enzymes, from a commercial viewpoint, include sugar isomerases such as glucose isomerase. Other metabolic enzymes have found commercial use such as glucose oxidases which produces ketogulonic acid (KGA). KGA is an intermediate in the commercial production of ascorbic acid using the Reichstein's procedure (see Krueger et al., *Biotechnology* 6(A), Rhine, H. J. et al., eds., Veriag Press, Weinheim, Germany (1984)).

Glucose oxidase (GOD) is commercially available and has been used in purified form as well as in an immobolized form for the deoxygeneration of beer. See Hartmeir et al., *Biotechnology Letters* 1:21 (1979). The most important application of GOD is the industrial scale fermentation of gluconic acid. Market for gluconic acids which are used in the detergent, textile, leather, photographic, pharmaceutical, food, feed and concrete industry (see Bigellis in *Gene Manipulations and Fungi*, Bennett, J. W. et al., eds., Academic Press, New York (1985), p. 357). In addition to industrial applications, GOD has found applications in medicine for quantitative determination of glucose in body fluids recently in biotechnology for analyzing syrups from starch and cellulose hydrosylates. See Owuss et al., *Biochem. et Biophysica. Acta.* 872:83 (1986).

The main sweetener used in the world today is sugar which comes from sugar beets and sugar cane. In the field of industrial enzymes, the glucose isomerase process shows the largest expansion in the market today. Initially, soluble enzymes were used and later immobolized enzymes were developed (Krueger et al., *Biotechnology, The Textbook of Industrial Microbiology*, Sinauer Associated Incorporated, Sunderland, Mass. (1990)). Today, the use of glucose-produced high fructose syrups is by far the largest industrial business using immobilized enzymes. A review of the industrial use of these enzymes is provided by Jorgensen, *Starch* 40:307 (1988).

Proteinases, such as alkaline serine proteinases, are used in detergent additives and thus represent one of the largest volumes of microbial enzymes used in the industrial sector. Because of their industrial importance, there is a large body of published and unpublished information regarding the use of these enzymes in industrial processes. (See Faultman et al., *Acid Proteases Structure Function and Biology*, Tang, J., ed., Plenum Press, New York (1977) and Godfrey et al., *Industrial Enzymes*, MacMillan Publishers, Surrey, UK (1983) and Hepner et al., *Report Industrial Enzymes by 1990*, Hel Hepner & Associates, London (1986)).

Another class of commercially usable proteins of the present invention are the microbial lipases identified in Table 1 (see Macrae et al., *Philosophical Transactions of the Chiral Society of London* 310:227 (1985) and Poserke, *Journal of the American Oil Chemist Society* 61:1758 (1984). A major use of lipases is in the fat and oil industry for the production of neutral glycerides using lipase catalyzed inter-esterification of readily available triglycerides. Application of lipases include the use as a detergent additive to facilitate the removal of fats from fabrics in the course of the washing procedures.

The use of enzymes, and in particular microbial enzymes, as catalyst for key steps in the synthesis of complex organic molecules is gaining popularity at a great rate. One area of great interest is the preparation of chiral intermediates. Preparation of chiral intermediates is of interest to a wide range of synthetic chemists particularly those scientists involved with the preparation of new pharmaceuticals, agrochemicals, fragrances and flavors. (See Davies et al., *Recent Advances in the Generation of Chiral Intermediates Using Enzymes*, CRC Press, Boca Raton, Fla. (1990)). The following reactions catalyzed by enzymes are of interest to organic chemists: hydrolysis of carboxylic acid esters, phosphate esters, amides and nitriles, esterification reactions, trans-esterification reactions, synthesis of amides, reduction of alkanones and oxoalkanates, oxidation of alcohols to carbonyl compounds, oxidation of sulfides to sulfoxides, and carbon bond forming reactions such as the aldol reaction. When considering the use of an enzyme encoded by one of the ORF's of the present invention for biotransformation and organic synthesis it is sometimes necessary to consider the respective advantages and disadvantages of using a microorganism as opposed to an isolated enzyme. Pros and cons of using a whole cell system on the one hand or an isolated partially purified enzyme on the other hand, has been described in detail by Bud et al., *Chemistry in Britain* (1987), p. 127.

Amino transferases, enzymes involved in the biosynthesis and metabolism of amino acids, are useful in the catalytic production of amino acids. The advantages of using microbial based enzyme systems is that the amino transferase enzymes catalyze the stereo-selective synthesis of only 1-amino acids and generally possess uniformly high catalytic rates. A description of the use of amino transferases for amino acid production is provided by Roselle-David, *Methods of Enzymology* 136:479 (1987).

Another category of useful proteins encoded by the ORF's of the present invention include enzymes involved in nucleic acid synthesis, repair, and recombination. A variety of commercially important enzymes have previously been isolated from members of *Haemophilus* sp. These include the Hine II, Hind III, and Hind I restriction enconucleases. Table 1(a) identifies a wide array of enzymes, such as restriction enzymes, ligases, gyrases and methylases, which have intermediate use in the biotechnology industry.

2. Generation of Antibodies

As described here, the proteins of the present invention, as well as homologs thereof, can be used in a variety procedures and methods known in the art which are currently applied to other proteins. The proteins of the present invention can further be used to generate an antibody which selectively binds the protein. Such antibodies can be either monoclonal or polyclonal antibodies, as well fragments of these antibodies, and humanized forms.

The invention further provides antibodies which selectively bind to one of the proteins of the present invention and hybridomas which produce these antibodies. A hybridoma is an immortalized cell line which is capable of secreting a specific monoclonal antibody.

In general, techniques for preparing polyclonal and monoclonal antibodies as well as hybridomas capable of producing the desired antibody are well known in the art (Campbell, A. M., *Monoclonal Antibody Technology: Laboratory Techniques in Biochemistry and Molecular Biology*, Elsevier Science Publishers, Amsterdam, The Netherlands (1984): St. Groth et al., *J. Immunol. Methods* 35:1–21 (1980): Kohler and Milstein, *Nature* 256:495–497 (1975)), the trioma technique, the human B-cell hybridoma technique (Kozbor et al., *Immunology Today* 4:72 (1983): Cole et al., in *Monoclonal Antibodies and Cancer Therapy*, Alan R. Liss, Inc. (1985), pp. 77–96.

Any animal (mouse, rabbit, etc.) which is known to produce antibodies can be immunized with the pseudogene polypeptide. Methods for immunization are well known in the art. Such methods include subcutaneous or interperitoneal injection of the polypeptide. One skilled in the art will recognize that the amount of the protein encoded by the ORF of the present invention used for immunization will vary based on the animal which is immunized, the antigenicity of the peptide and the site of injection.

The protein which is used as an immunogen may be modified or administered in an adjuvant in order to increase the protein's antigenicity. Methods of increasing the antigenicity of a protein are well known in the art and include, but are not limited to coupling the antigen with a heterologous protein (such as glubolin or β-galactosidase) or through the inclusion of an adjuvant during immunization.

For monoclonal antibodies, spleen cells from the immunized animals are removed, fused with myeloma cells, such as SP2/0-Ag14 myeloma cells, and allowed to become monoclonal antibody producing hybridoma cells.

Any one of a number of methods well known in the art can be used to identify the hybridoma cell which produces an antibody with the desired characteristics. These include screening the hybridomas with an ELISA assay, western block analysis, or radioimmunoassay (Lutz et al., *Exp. Cell Res.* 175:109–124 (1988)).

Hybridomas secreting the desired antibodies are cloned and the class and subclass is determined using procedures known in the art (Campbell, A. M., *Monoclonal Antibody Technology: Laboratory Techniques in Biochemistry and Molecular Biology*, Elsevier Science Publishers, Amsterdam, The Netherlands (1984)).

Techniques described for the production of single chain antibodies (U.S. Pat. No. 4,946,778) can be adapted to produce single chain antibodies to proteins of the present invention.

For polyclonal antibodies, antibody containing antisera is isolated from the immunized animal and is screened for the presence of antibodies with the desired specificity using one of the above-described procedures.

The present invention further provides the above-described antibodies in detectably labelled form. Antibodies can be detectably labelled through the use of radioisotopes, affinity labels (such as biotin, avidin, etc.), enzymatic labels (such as horseradish peroxidase, alkaline phosphotase, etc.) fluorescent labels (such as FITC or rhodamine, etc.), paramagnetic atoms, etc. Procedures for accomplishing such labelling are well-known in the art, for example see (Sternberger, L. A. et al., *J. Histochem. Cytochem.* 18:315 (1970); Bayer, E. A. et al., *Meth. Enzym.* 62:308 (1979); Engval, E. et al., *Immunol.* 109:129 (1972); Goding, J. W. *J. Immunol. Meth.* 13:215 (1976)).

The labeled antibodies of the present invention can be used for in vitro, in vivo, and in situ assays to identify cells or tissues in which a fragment of the *Haemophilus influenzae* Rd genome is expressed.

The present invention further provides the above-described antibodies immobilized on a solid support. Examples of such solid supports include plastics such as polycarbonate, complex carbohydrates such as agarose and sepharose, acrylic resins and such as polyacrylamide and latex beads. Techniques for coupling antibodies to such solid supports are well known in the art (Weir, D. M. et al., *"Handbook of Experimental Immunology"* 4th Ed., Blackwell Scientific Publications, Oxford, England, Chapter 10 (1986): Jacoby, W. D. et al., *Meth. Enzym.* 34 Academic Press, N.Y. (1974)). The immunized antibodies of the present invention can be used for in vitro, in vivo, and in situ assays as well as for immunoaffinity purification of the proteins of the present invention.

3. Diagnostic Assays and Kits

The present invention further provides methods to identify the expression of one of the ORF's of the present invention, or homolog thereof, in a test sample, using one of the DFs or antibodies of the present invention.

In detail, such methods comprise incubating a test sample with one or more of the antibodies or one or more of the DFs of the present invention and assaying for binding of the DFs or antibodies to components within the test sample.

Conditions for incubating a DF or antibody with a test sample vary. Incubation conditions depend on the format employed in the assay, the detection methods employed, and the type and nature of the DF or antibody used in the assay. One skilled in the art will recognize that any one of the commonly available hybridization, amplification or immunological assay formats can readily be adapted to employ the DFs or antibodies of the present invention. Examples of such assays can be found in Chard, T., *An Introduction to Radioimmunoassay and Related Techniques*, Elsevier Science Publishers, Amsterdam, The Netherlands (1986); Bullock, G. R. et al., *Techniques in Immunocytochemistry*, Academic Press, Orlando, Fla. Vol. 1 (1982), Vol. 2 (1983), Vol. 3 (1985); Tijssen, P., *Practice and Theory of Enzyme Immunoassays: Laboratory Techniques in Biochemistry and Molecular Biology*, Elsevier Science Publishers, Amsterdam, The Netherlands (1985).

The test samples of the present invention include cells, protein or membrane extracts of cells, or biological fluids such as sputum, blood, serum, plasma, or urine. The test sample used in the above-described method will vary based on the assay format, nature of the detection method and the tissues, cells or extracts used as the sample to be assayed. Methods for preparing protein extracts or membrane extracts of cells are well known in the art and can be readily be adapted in order to obtain a sample which is compatible with the system utilized.

In another embodiment of the present invention, kits are provided which contain the necessary reagents to carry out the assays of the present invention.

Specifically, the invention provides a compartmentalized kit to receive, in close confinement, one or more containers which comprises: (a) a first container comprising one of the DFs or antibodies of the present invention; and (b) one or more other containers comprising one or more of the following: wash reagents, reagents capable of detecting presence of a bound DF or antibody.

In detail, a compartmentalized kit includes any kit in which reagents are contained in separate containers. Such containers include small glass containers, plastic containers or strips of plastic or paper. Such containers allows one to efficiently transfer reagents from one compartment to another compartment such that the samples and reagents are not cross-contaminated, and the agents or solutions of each container can be added in a quantitative fashion from one compartment to another. Such containers will include a container which will accept the test sample, a container which contains the antibodies used in the assay, containers which contain wash reagents (such as phosphate buffered saline, Tris-buffers, etc.), and containers which contain the reagents used to detect the bound antibody or DF.

Types of detection reagents include labelled nucleic acid probes, labelled secondary antibodies, or in the alternative, if the primary antibody is labelled, the enzymatic, or antibody binding reagents which are capable of reacting with the labelled antibody. One skilled in the art will readily recognize that the disclosed DFs and antibodies of the present invention can be readily incorporated into one of the established kit formats which are well known in the art.

4. Screening Assay for Binding Agents

Using the isolated proteins of the present invention, the present invention further provides methods of obtaining and identifying agents which bind to a protein encoded by one of the ORFs of the present invention or to one of the fragments and the *Haemophilus* genome herein described.

In detail, said method comprises the steps of:
(a) contacting an agent with an isolated protein encoded by one of the ORFs of the present invention, or an isolated fragment of the *Haemophilus* genome; and
(b) determining whether the agent binds to said protein or said fragment.

The agents screened in the above assay can be, but are not limited to, peptides, carbohydrates, vitamin derivatives, or other pharmaceutical agents. The agents can be selected and screened at random or rationally selected or designed using protein modelling techniques.

For random screening, agents such as peptides, carbohydrates, pharmaceutical agents and the like are selected at random and are assayed for their ability to bind to the protein encoded by the ORF of the present invention.

Alternatively, agents may be rationally selected or designed. As used herein, an agent is said to be "rationally selected or designed" when the agent is chosen based on the configuration of the particular protein. For example, one skilled in the art can readily adapt currently available procedures to generate peptides, pharmaceutical agents and the like capable of binding to a specific peptide sequence in order to generate rationally designed antipeptide peptides, for example see Hurby et al., Application of Synthetic Peptides: Antisense Peptides," In *Synthetic Peptides, A User's Guide*, W. H. Freeman, NY (1992), pp. 289–307, and Kaspczak et al., *Biochemistry* 28:9230–8 (1989), or pharmaceutical agents or the like.

In addition to the foregoing, one class of agents of the present invention, as broadly described, can be used to control gene expression through binding to one of the ORFs or EMFs of the present invention. As described above, such agents can be randomly screened or rationally designed/selected. Targeting the ORF or EMF allows a skilled artisan to design sequence specific or element specific agents, modulating the expression of either a single ORF or multiple ORFs which rely on the same EMF for expression control.

One class of DNA binding agents are agents which contain base residues which hybridize or form a triple helix formation by binding to DNA or RNA. Such agents can be based on the classic phosphodiester, ribonucleic acid backbone, or can be a variety of sulfhydryl or polymeric derivatives which have base attachment capacity.

Agents suitable for use in these methods usually contain 20 to 40 bases and are designed to be complementary to a region of the gene involved in transcription (triple helix—see Lee et al., *Nucl. Acids. Res.* 6:3073 (1979); Cooney et al., *Science* 241:456 (1988); and Dervan et al., *Science* 251:1360 (1991)) or to the mRNA itself (antisense—Okano, j. *Neurochem.* 56:560 (1991); *Oligodeoxynucleotides as Antisense Inhibitors of Gene Expression*, CRC Press, Boca Raton, Fla. (1988)). Triple helix-formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention is necessary for the design of an antisense or triple helix oligonucleotide and other DNA binding agents.

Agents which bind to a protein encoded by one of the ORFs of the present invention can be used as a diagnostic agent, in the control of bacterial infection by modulating the activity of the protein encoded by the ORF. Agents which bind to a protein encoded by one of the ORFs of the present invention can be formulated using known techniques to generate a pharmaceutical composition for use in controlling *Haemophilus* growth and infection.

5. Vaccine and Pharmaceutical Composition

The present invention further provides pharmaceutical agents which can be used to modulate the growth of *Haemophilus influenzae*, or another related organism, in vivo or in vitro. As used herein, a "pharmaceutical agent" is defined as a composition of matter which can be formulated using known techniques to provide a pharmaceutical compositions. As used herein, the "pharmaceutical agents of the present invention" refers the pharmaceutical agents which are derived from the proteins encoded by the ORFs of the present invention or are agents which are identified using the herein described assays.

As used herein, a pharmaceutical agent is said to "modulate the growth of *Haemophilus* sp., or a related organism, in vivo or in vitro," when the agent reduces the rate of growth, rate of division, or visability of the organism in question. The pharmaceutical agents of the present invention can modulate the growth of an organism in many fashions, although an understanding of the underlying mechanism of action is not needed to practice the use of the pharmaceutical agents of the present invention. Some agents will modulate the growth by binding to an important protein thus blocking the biological activity of the protein, while other agents may bind to a component of the outer surface of the organism blocking attachment or rendering the organism more prone to act the bodies nature immune system. Alternatively, the agent may be comprise a protein encoded by one of the ORFs of the present invention and serve as a vaccine. The development and use of a vaccine based on outer membrane components, such as the LPS, are well known in the art.

As used herein, a "related organism" is a broad term which refers to any organism whose growth can be modulated by one of the pharmaceutical agents of the present invention. In general, such an organism will contain a homolog of the protein which is the target of the pharmaceutical agent or the protein used as a vaccine. As such, related organism do not need to be bacterial but may be fungal or viral pathogens.

The pharmaceutical agents and compositions of the present invention may be administered in a convenient manner such as by the oral, topical, intravenous, intraperitoneal, intramuscular, subcutaneous, intranasal or intradermal routes. The pharmaceutical compositions are administered in an amount which is effective for treating and/or prophylaxis of the specific indication. In general, they are administered in an amount of at least about 10 $\mu$g/kg body weight and in most cases they will be administered in an amount not in excess of about 8 mg/Kg body weight per day. In most cases, the dosage is from about 10 $\mu$g/kg to about 1 mg/kg body weight daily, taking into account the routes of administration, symptoms, etc.

The agents of the present invention can be used in native form or can be modified to form a chemical derivative. As used herein, a molecule is said to be a "chemical derivative" of another molecule when it contains additional chemical moieties not normally a part of the molecule. Such moieties may improve the molecule's solubility, absorption, biological half life, etc. The moieties may alternatively decrease the toxicity of the molecule, eliminate or attenuate any undesirable side effect of the molecule, etc. Moieties capable of mediating such effects are disclosed in *Remington's Pharmaceutical Sciences* (1980).

For example, a change in the immunological character of the functional derivative, such as affinity for a given antibody, is measured by a competitive type immunoassay. Changes in immunomodulation activity are measured by the appropriate assay. Modifications of such protein properties as redox or thermal stability, biological half-life, hydrophobicity, susceptibility to proteolytic degradation or the tendency to aggregate with carriers or into multimers are assayed by methods well known to the ordinarily skilled artisan.

The therapeutic effects of the agents of the present invention may be obtained by providing the agent to a patient by any suitable means (i.e., inhalation, intravenously, intramuscularly, subcutaneously, enterally, or parenterally). It is preferred to administer the agent of the present invention so as to achieve an effective concentration within the blood or tissue in which the growth of the organism is to be controlled.

To achieve an effective blood concentration, the preferred method is to administer the agent by injection. The administration may be by continuous infusion, or by single or multiple injections.

In providing a patient with one of the agents of the present invention, the dosage of the administered agent will vary depending upon such factors as the patient's age, weight, height, sex, general medical condition, previous medical history, etc. In general, it is desirable to provide the recipient with a dosage of agent which is in the range of from about 1 pg/kg to 10 mg/kg (body weight of patient), although a lower or higher dosage may be administered. The therapeutically effective dose can be lowered by using combinations of the agents of the present invention or another agent.

As used herein, two or more compounds or agents are said to be administered "in combination" with each other when either (1) the physiological effects of each compound, or (2) the serum concentrations of each compound can be measured at the same time. The composition of the present invention can be administered concurrently with, prior to, or following the administration of the other agent.

The agents of the present invention are intended to be provided to recipient subjects in an amount sufficient to decrease the rate of growth (as defined above) of the target organism.

The administration of the agent(s) of the invention may be for either a "prophylactic" or "therapeutic" purpose. When provided prophylactically, the agent(s) are provided in advance of any symptoms indicative of the organisms growth. The prophylactic administration of the agent(s) serves to prevent, attenuate, or decrease the rate of onset of any subsequent infection. When provided therapeutically, the agent(s) are provided at (or shortly after) the onset of an indication of infection. The therapeutic administration of the compound(s) serves to attenuate the pathological symptoms of the infection and to increase the rate of recovery.

The agents of the present invention are administered to be mammal in a pharmaceutically acceptable form and in a therapeutically effective concentration. A composition is said to be "pharmacologically acceptable" if its administration can be tolerated by a recipient patient. Such an agent is said to be administered in a "therapeutically effective amount" if the amount administered is physiologically significant. An agent is physiologically significant if its presence results in a detectable change in the physiology of a recipient patient.

The agents of the present invention can be formulated according to known methods to prepare pharmaceutically useful compositions, whereby these materials, or their functional derivatives, are combined in admixture with a pharmaceutically acceptable carrier vehicle. Suitable vehicles and their formulation, inclusive of other human proteins, e.g., human serum albumin, are described, for example, in Remington's Pharmaceutical Sciences (16th ed., Osol, A., Ed., Mack, Easton, Pa. (1980)). In order to form a pharmaceutically acceptable composition suitable for effective administration, such compositions will contain an effective amount of one or more of the agents of the present invention, together with a suitable amount of carrier vehicle.

Additional pharmaceutical methods may be employed to control the duration of action. Control release preparations may be achieved through the use of polymers to complex or absorb one or more of the agents of the present invention. The controlled delivery may be exercised by selecting appropriate macromolecules (for example polyesters, polyamino acids, polyvinyl, pyrrolidone, ethylenevinylacetate, methylcellulose, carboxymethylcellulose, or protamine, sulfate) and the concentration of macromolecules as well as the methods of incorporation in order to control release. Another possible method to control the duration of action by controlled release preparations is to incorporate agents of the present invention into particles of a polymeric material such as polyesters, polyamino acids, hydrogels, poly(lactic acid) or ethylene vinylacetate copolymers. Alternatively, instead of incorporating these agents into polymeric particles, it is possible to entrap these materials in microcapsules prepared, for example, by coacervation techniques or by interfacial polymerization, for example, hydroxymethylcellulose or gelatine-microcapsules and poly(methylmethacrylate) microcapsules, respectively, or in colloidal drug delivery systems, for example, liposomes, albumin microspheres, microemulsions, nanoparticles, and nanocapsules or in macroemulsions. Such techniques are disclosed in Remington's Pharmaceutical Sciences (1980).

The invention further provides a pharmaceutical pack or kit comprising one or more containers filled with one or more of the ingredients of the pharmaceutical compositions of the invention. Associated with such container(s) can be a notice in the form prescribed by a governmental agency regulating the manufacture and/or sale of pharmaceuticals or biological products, which notice reflects approval by the agency of manufacture, use or sale for human administration. In addition, the agents of the present invention may be employed in conjunction with other therapeutic compounds.

6. Shot-Gun Approach to Megabase DNA Sequencing

The present invention further provides the first demonstration that a sequence of greater than one megabase can be sequenced using a random shotgun approach. This procedure, described in detail in the examples that follow, has eliminated the up front cost of isolating and ordering overlapping or contiguous subclones prior to the start of the sequencing protocols.

Certain aspects of the present invention are described in greater detail in the non-limiting Examples that follow.

EXAMPLES

Experimental Design and Methods

1. Shotgun Sequencing Strategy

The overall strategy for a shotgun approach to whole genome sequencing is outlined in Table 3. The theory of shotgun sequencing follows from the Lander and Waterman (Landerman and Waterman, Genomics 2: 231 (1988)) application of the equation for the Poisson distribution $p_x = m^x e^{-m}/x!$, where x is the number of occurrences of an event, m is the mean number of occurrences, and $p_x$ is the probability that any given base is not sequenced after a certain amount of random sequence has been generated. If L is the genome length, n is the number of clone insert ends sequenced, and w is the sequencing read length, then m=nw/L, and the probability that no clone originates at any of the w bases preceding a given base, i.e., the probability that the base is not sequenced, is $p_o = e^{-m}$. Using the fold coverage as the unit for m, one sees that after 1.8 Mb of sequence has been randomly generated, m=1, representing 1× coverage. In this case, $p_o = e^{-1} = 0.37$, thus approximately 37% is unsequenced. For example, 5× coverage (approximately 9500 clones sequenced from both insert ends and an average sequence read length of 460 bp) yields $p_o = e^{-5} = 0.0067$, or 0.67% unsequenced. The total gap length is $Le^{-m}$, and the average gap size is L/n. 5× coverage would leave about 128 gaps averaging about 100 bp in size. The treatment is essentially that of Lander and Waterman, Genomics 2:231 (1988). Table 4 illustrates the coverage for a 1.9 Mb genome with an average fragment size of 460 bp.

2. Random Library Construction

In order to approximate the random model described above during actual sequencing, a nearly ideal library of cloned genomic fragment is required. The following library construction procedure was developed to achieve this.

H. influenzae Rd KW20 DNA was prepared by phenol extraction. A mixture (3.3 ml) containing 600 μg DNA, 300 mM sodium acetate, 10 mM Tris-HCl, 1 mM Na-EDTA, 30% glycerol was sonicated (Branson Model 450 Sonicator) at the lowest energy setting for 1 min. at 0° using a 3 mm probe. The DNA was ethanol precipitated and redissolved in 500 μl TE buffer. To create blunt-ends, a 100 μl aliquot was digested for 10 min at 30° in 200 μl BAL31 buffer with 5 units BAL31 nuclease (New England BioLabs). The DNA was phenol-extracted, ethanol-precipitated, redissolved in 100 μl TE buffer, electrophoresed on a 1.0% low melting agarose gel, and the 1.6–2.0 kb size fraction was excised, phenol-extracted, and redissolved in 20 μl TE buffer. A two-step ligation procedure was used to produce a plasmid library with 97% insert of which >99% were single inserts. The first ligation mixture (50 μl) contained 2 μg of DNA fragments, 2 μg SmaI/BAP pUC18 DNA (Pharmacia), and 10 units T4 ligase (GIBCO/BRL), and incubation was at 14° for 4 hr. After phenol extraction and ethanol precipitation, the DNA was dissolved in 20 μl TE buffer and electrophoresed on a 1.0% low melting agarose gel. A ladder of ethidium bromide-stained linear bands, identified by size as insert (i), vector (v), v+i, v+2i, v+3i, . . . was visualized by 360 nm UV light, and the v+i DNA was excised and recovered in 20 μl TE. The v+i DNA was blunt-ended by T4 polymerase treatment for 5 min. at 37° in a reaction mixture (50 μl) containing the v+i linears, 500 μM each of the 4 dNTP's, and 9 units of T4 polymerase (New England BioLabs) uner recommended buffer conditions. After phenol extraction and ethanol precipitation the repaired v+i linears were dissolved in 20 μl TE. The final ligation to produce circles was carried out in a 50 μl reaction containing 5 μl of v+i linears and 5 units of T4 ligase at 14° overnight. After 10 min. at 70° the reaction mixture was stored at −20°.

This two-stage procedure resulted in a molecularly random collection of single-insert plasmid recombinants with minimal contamination from double-insert chimeras (<1%) or free vector (<3%). Since deviation from randomness is most likely to occur during cloning. E. coli host cells deficient in all recombination and restriction functions (A. Greener, *Strategies* 3 (1):5 (1990)) were used to prevent rearrangements, deletions, and loss of clones by restriction. Transformed cells were plated directly on antibiotic diffusion plates to avoid the usual broth recovery phase which allows multiplication and selection of the most rapidly growing cells. Plating occured as follows:

A 100 μl aliquot of Epicurian Coli SURE II Supercompetent Cells (Stratagene 200152) was thawed on ice and transferred to a chilled Falcon 2059 tube on ice. A 1.7 μl aliquot of 1.42 M β-mercaptoethanol was added to the aliquot of cells to a final concentration of 25 mM. Cells were incubated on ice for 10 min. A 1 μl aliquot of the final ligation was added to the cells and incubated on ice for 30 min. The cells were heat pulsed for 30 sec. at 42° and placed back on ice for 2 min. The outgrowth period in liquid culture was eliminated from this protocol in order to minimize the preferential growth of any given transformed cell. Instead the transformation were plated directly on a nutrient rich SOB plate containing a 5 ml bottom layer of SOB agar (1.5% SOB agar: 20 g tryptone, 5 g yeast extract, 0.5 g NaCl, 1.5% Difco Agar/L). The 5 ml bottom layer is supplemented with 0.4 ml ampicillin (50 mg/ml)/100 ml SOB agar. This 15 ml top layer of SOB agar is supplemented with 1 ml X-Gal (2%), 1 ml MgCl$_2$ (1 M), and 1 ml MgSO$_4$/100 ml SOB agar. The 15 ml top layer was poured just prior to plating. Our titer was approximately 100 colonies/10 μl aliquot of transformation.

All colonies were picked for template preparation regardless of size. Only clones lost due to "poison" DNA or deleterious gene products would be deleted from the library, resulting in a slight increase in gap number over that expected.

Figure 3:
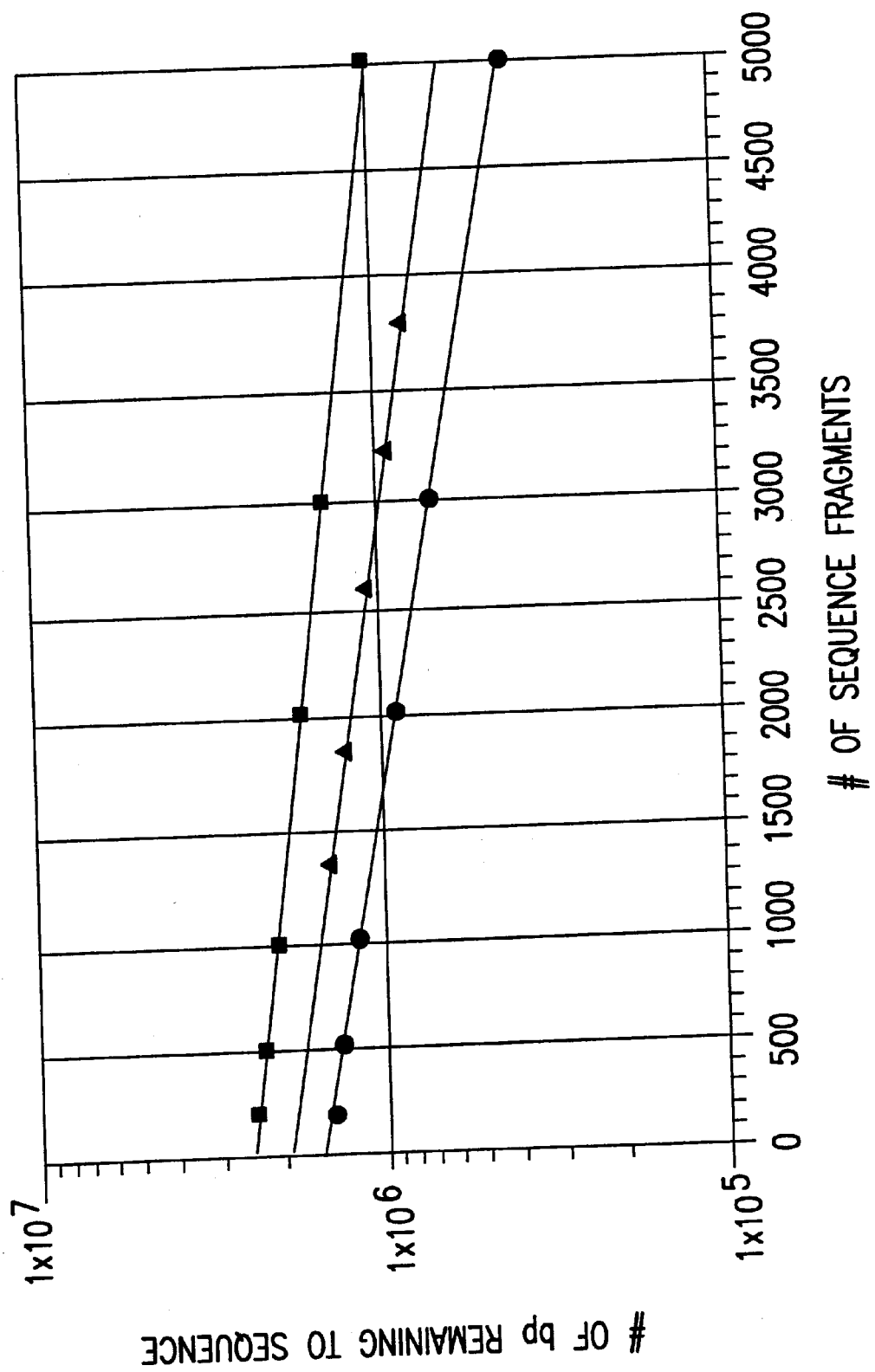
FIG. 3—A comparison of experimental coverage of up to approximately 4000 random sequence fragments assembled with AutoAssembler (squares) as compared to Lander-Waterman prediction for a 2.5 Mb genome (triangles) and a 1.6 Mb genome (circles) with a 400 bp average sequence length and a 25 bp overlap.

In order to evaluate the quality of the *H. influenzae* library, sequence data were obtained from approximately 4000 templates using the M13-21 primer. The random sequence fragments were assembled using the AutoAssembler™ software (Applied Biosystems division of Perkin-Elmer (AB)) after obtaining 1300, 1800, 2500, 3200, and 3800 sequence fragments, and the number of unique assembled base pairs was determined. Based on the equations described above, an ideal plot of the number of base pairs remaining to be sequenced as a function of the # of sequenced fragments obtained with an average read length of 460 bp for a $2.5\times10^4$ and a $1.9\times10^4$ bp genome was determined (FIG. 3). The progression of assembly was plotted using the actual data obtained from the assembly of up to 3800 sequence fragments and compared the data that is provided in the ideal plot (FIG. 3). FIG. 3 illustrates that there was essentially no deviation of the actual assembly data from the ideal ploat, indicating that we had constructed close to an ideal random library with minimal contamination from double insert chimeras and free of vector.

3. Random DNA Sequencing

High quality double stranded DNA plasmid templates (19,687) were prepared using a "boiling bead" method developed in collaboration with Advanced Genetic Technology Corp. (Gathersburg, Md.) (Adams et al., *Science* 252:1651 (1991); Adams et al., *Nature* 355:632 (1992)). Plamid preparation was performed in a 96-well format for all stages of DNA preparation from bacterial growth through final DNA purification. Template concentration was determined using Hoechst Dye and a Millipore Cytofluor. DNA concentrations were not adjusted, but low-yielding templates were identified where possible and not sequenced. Templates were also prepared from two *H. influenzae* lambda genomic libraries. An amplified library was constructed in vector Lambda GEM-12 (Promega) and an unamplified library was constructed in Lambda DASH II (Stratagene). In particular, for the unamplified lambda library, *H. influenzae* Rd KW20 DNA (>100 kb) was partially digested in a reaction mixture (200 μl) containing 50 μg DNA, 1× Sau3Al buffer, 20 units Sau3Al for 6 min. at 23°. The digested DNA was phenol-extracted and electrophoresed on a 0.5% low melting agarose gel at 2V/cm for 7 hours. Fragments from 15 to 25 kb were excised and recovered in a final volume of 6 μl. One μl of fragments was used with 1 μl of DASHII vector (Stratagene) in the recommended ligation reaction. One μl of the ligation mixture was used per packaging reaction following the recommended protocol with the Gigapack II XL Packaging Extract (Stratagene, #227711). Phage were plated directly without amplification from the packaging mixture (after dilution with 500 μl of recommended SM buffer and chloroform treatment). Yield was about $2.5\times10^3$ pfu/μl. The amplified library was prepared essentially as above except the lambda GEM-12 vector was used. After packaging, about $3.5\times10^4$ pfu were plated on the restrictive NM539 host. The lysate was harvested in 2 ml of SM buffer and stored frozen in 7% dimethylsulfoxide. The phage titer was approximately $1\times10^9$ pfu/ml.

Liquid lysates (10 ml) were prepared from randomly selected plaques and template was prepared on an anion-exchange resin (Qiagen). Sequencing reactions were carried out on plasmid templates using the AB Catalyst LabStation with Applied Biosystems PRISM Ready Reaction Dye Primer Cycle Sequencing Kits for the M13 forward (M13-21) and the M13 reverse (M13RP1) primers (Adams et al., *Nature* 368:474 (1994)). Dye terminator sequencing reactions were carried out on the lambda templates on a Perkin-Elmer 9600 Thermocycler using the Applied Biosystems Ready Reaction Dye Terminator Cycle Sequencing kits. T7 and SP6 primers were used to sequence the ends of the inserts from the Lambda GEM-12 library and T7 and T3 primers were used to sequence the ends of the inserts from the Lambda DASH II library. Sequencing reactions (28,643) were performed by eight individuals using an average of fourteen AB 373 DNA Sequencers per day over a 3 month period. All sequencing reactions were analyzed using the Stretch modification of the AB 373, primarily using a 34 cm well-to-read distance. The overall sequencing success rate was 84% for M13-21 sequences, 83% for M13RP1 sequences and 65% for dye-terminator reactions. The average usable read length was 485 bp for M13-21 sequences, 444 bp for M13RP1 sequences, and 375 bp for dye-terminator reactions. Table 5 summarizes the high-throughput sequencing phase of the invention.

Richards, et al. (Richards et al., *Automated DNA sequencing and Analysis*, M. D. Adams, C. Fields, J. C. Venter, Eds. (*Academic Press, London,* 1994), Chap. 28.) described the value of using sequence from both ends of sequencing templates to facilitate ordering of contigs in shotgun assembly projects of lambda and cosmid clones. We balanced the desirability of both-end sequencing (including the reduced cost of lower total number of templates) against shorter read-lengths for sequencing reactions performed with the M13RP1 (reverse) primer compared to the M13-21 (forward) primer. Approximately one-half of the templates were sequenced from both ends. In total, 9,297 M13RP1 sequencing reactions were done. Random reverse sequencing reactions were done based on successful forward sequencing reactions. Some M13RP1 sequences were obtained in a semi-directed fashion: M13-21 sequences pointing outward at the ends of contigs were chosen for M13RP1 sequencing in an effort to specifically order contigs. The semi-directed strategy was effective, and clone-based ordering formed an integral part of assembly and gap closure (see below).

4. Protocol for Automated Cycle Sequencing

The sequencing consisted of using eight ABI Catalyst robots and fourteen AB 373 Automated DNA Sequencers. The Catalyst robot is a publicly available sophisticated pipetting and temperature control robot which has been developed specifically for DNA sequencing reactions. The Catalyst combines pre-aliquoted templates and reaction mixes consisting of deoxy- and dideoxynucleotides, the Taq thermostable DNA polymerase, fluorescently-labelled sequencing primers, and reaction buffer. Reaction mixes and templates were combined in the wells of an aluminum 96-well thermocycling plate. Thirty consecutive cycles of linear amplification (e.g., one primer synthesis) steps were performed including denaturation, annealing of primer and template, and extension of DNA synthesis. A heated lid with rubber gaskets on the thermocycling plate prevented evaporation without the need for an oil overlay.

Two sequencing protocols were used: dye-labelled primers and dye-labelled dideoxy chain terminators. The shotgun sequencing involves use of four dye-labelled sequencing primers, one for each of the four terminator nucleotide. Each dye-primer is labelled with a different fluorescent dye, permitting the four individual reactions to be combined into one lane of the 373 DNA Sequencer for electrophoresis, detection, and base-calling. AB currently supplies pre-mixed reaction mixes in bulk packages containing all the necessary non-template reagents for sequencing. Sequencing can be done with both plasmid and PCR-generated templates with both dye-primers and dye-terminators with approximately equal fidelity, although plasmid templates generally give longer usable sequences.

Thirty-two reactions were loaded per 373 Sequencer each day, for a total of 960 samples. Electrophoresis was run overnight following the manufacture's protocols, and the data was collected for twelve hours. Following electrophoresis and fluorescence detection, the AB 373 performs automatic lane tracking and base-calling. The lane-tracking was confirmed visually. Each sequence electropherogram (or fluorescence lane trace) was inspected visually and assessed for quality. Trailing sequences of low quality were removed and the sequence itself was loaded via software to a Sybase database (archived daily to a 8 mm tape). Leading vector polylinker sequence was removed automatically by software program. Average edited lengths of sequences from the standard ABI 373 were around 400 bp and depended mostly on the quality of the template used for the sequencing reaction. All of the ABI 373 Sequencers were converted to Stretch Liners, which provided a longer electrophoresis path prior to fluorescence detection, thus increasing the average number of usable bases to 500–600 bp.

Informatics

1. Data Management

Figure 4:
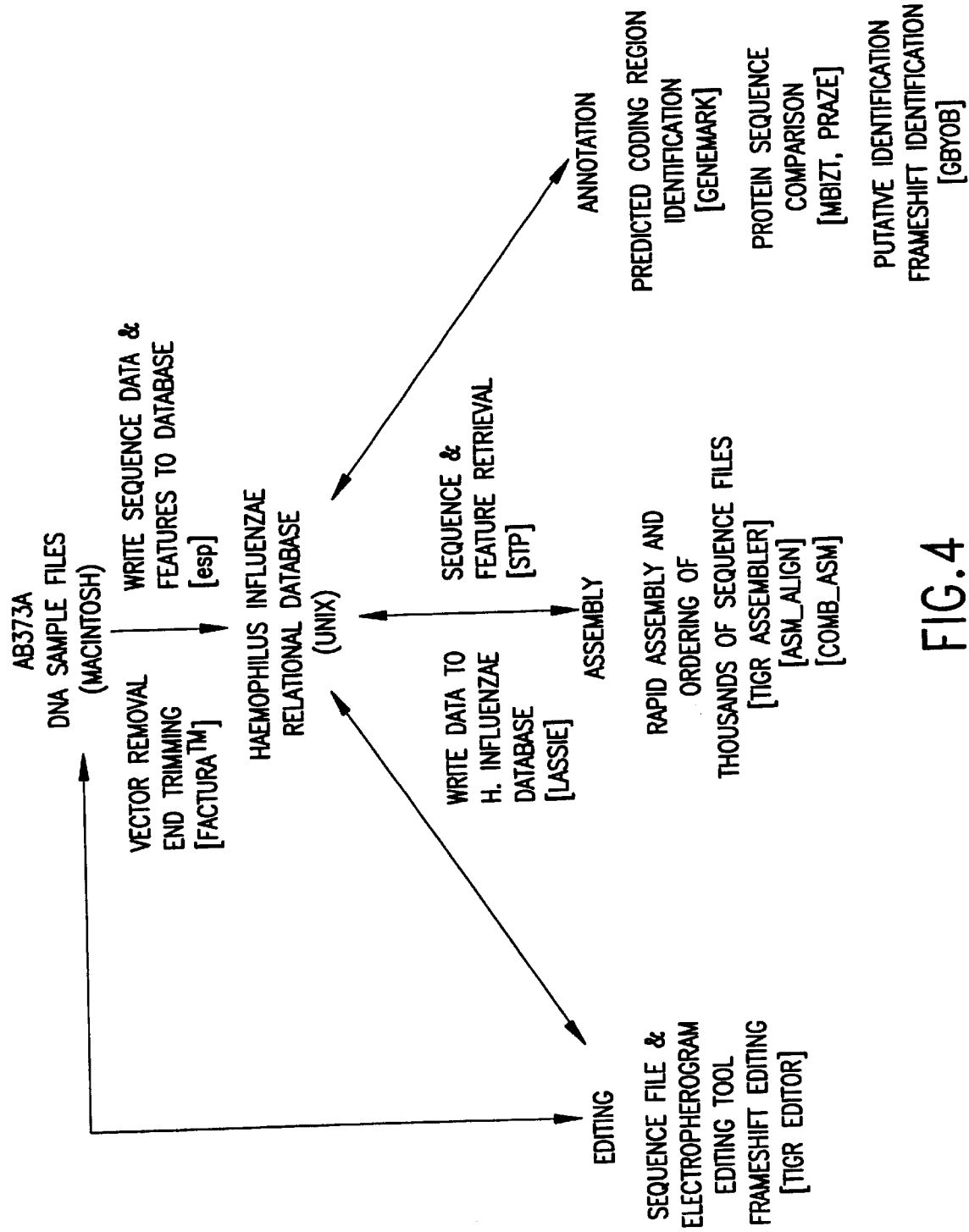
FIG. 4—Data flow and computer programs used to manage, assemble, edit, and annotate the *H. influenzae* genome. Both Macintosh and Unix platforms, are used to handle the AB 373 sequence data files (Kerlavage et al., *Proceedings of the Twenty-Sixth Annual Hawaii International Conference on System Sciences*, IEEE Computer Society Press, Washington D.C., 585 (1993)). Fracture (AB) is a Macintosh program designed for automatic vector sequence removal and end trimming of sequence files. The program esp runs on a Macintosh platform to the Unix based *H. influenzae* relational database. Assembly is accomplished by retrieving a specific set of sequence files and their associated features using stp, an X-windows graphical interface and control program which can retrieve sequences from the *H. influenzae* database using user-defined or standard SQL queries. The sequence files were assembled using TIGR Assembler, an assembly engine designed at TIGR for rapid and accurate assembly of thousands of sequence fragments. TIGR Editor is a graphical interface which can parse the aligned sequence files from TIGR Assembler output and display the alignment and associated electropherograms for contig editing. Identification of putative coding regions was performed with Genemark (Borodovsky and McIninch, *Computers Chem.* 17(2): 123 (1993)), a Markov and Bayes modeled program for predicting gene locations, and trained on a *H. influenzae* sequence data net. Peptide searches were performed against the three reading frames of each Genemark predicted coding region using blaze (Brutlag et al., *Computers Chem.* 17:203 (1993)) run on a Maspar MP-2 massively parallel computer with 4096 microprocessors. Results from each frame were combined into a single output file by subtext, Optimal protein alignments were obtained using the program prane which extends alignments across potential frameshifts. The output was inspected using a custom graphic viewing program, gbyeb, that interacts directly with the *H. influenzae* database. The alignments were further used to identify potential frameshift errors and were targeted for additional editing.

A number of information management systems (LIMA) for a large-scale sequencing lab have been developed (Kerlavage et al., *Proceedings of the Twenty-Sixth Annual Hawaii International Conference on System Sciences*, IEEE Computer Society Press, Washington D.C., 585 (1993)). The system used to collect and assemble the sequence data was developed using the Sybase relational data management system and was designed to automate data flow whereever possible and to reduce user error. The database stores and correlates all information collected during the entire operation from template preparation to final analysis of the genome. Because the raw output of the AB 373 Sequencers was based on a Macintosh platform and the data management system chosen was based on a Unix platform, it was necessary to design and implement a variety of multi-user, client server applications which allow the raw data as well as analysis results to flow seamlessly into the database with a minimum of user effort. A description of the software programs used for large sequence assembly and managment is provided in FIG. 4.

2. Assembly

An assembly engine (TIGR Assembler) was developed for the rapid and accurate assembly of thousands of sequence fragments. The AB AutoAssembler™ was modified (and named TIGR Editor) to provide a graphical interface to the electropherogram for the purpose of editing data associated with the aligned sequence file output of TIGR Assembler. TIGR Editor maintains synchrony between the electropherogram files on the Macintosh platform and the sequence data in the *H. influenzae* database on the Unix platform.

The TIGR assembler simultaneously clusters and assembles fragments of the genome. In order to obtain the speed necessary to assemble more than $10^4$ fragments, the algorithm builds a hash table of 10 bp oligonucleotide subsequences to generate a list of potential sequence fragment overlaps. The number of potential overlaps for each fragment determines which fragments are likely to fall into repetitive elements. Beginning with a single seed sequence fragment, TIGR Assembler extends the current contig by attempting to add the best matching fragment based on oligonucleotide content. The current contig and candidate fragment are aligned using a modified version of the Smith-Waterman algorithm (Waterman, M. S., *Methods in Enzymology* 164:765 (1988)) which provides for optimal gapped alignments. The current contig is extended by the fragment only if strict criteria for the quality of the match are met. The match criteria include the minimum length of overlap, the maximum length of all unmatched end, and the minimum percentage match. These criteria are automatically lowered by the algorithm in regions of minimal coverage and raised in regions with a possible repetitive element. The number of potential overlaps for each fragment determines which fragments are likely to fall into repetitive elements. Fragments representing the boundaries of repetitive elements and potentially chimeric fragments are often rejected based on partial mismatches at the ends of alignments and excluded from the current contig. TIGR Assembler is designed to take advantage of clone size information coupled with sequencing from both ends of each template. It enforces the constraint that sequence fragments from two ends of the same template point toward one another in the contig and are located within a certain ranged of base pairs (definable for each clone based on the known clone size range for a given library). Assembly of 24,304 sequence fragments of *H. influenzae* required 30 hours of CPU time using one processor on a SPARCenter 2000 with 512 Mb of RAM. This process resulted in approximately 210 contigs. Because of the high stringency of the TIGR Assembler, all contigs were searched against each other using grasta (a modified fasta (Person and Lipman, *Proc. Natl. Acad. Sci. U.S.A.* 85:2444 (1988)). In this way, additional overlaps were detected which enabled compression oof the data set into 140 contigs. The location of each fragment in the contigs and extensive information about the consensus sequence itself were loaded into the *H. influenzae* relational database.

3. Ordering Assembled Contigs

After assembly the relative positions of the 140 contigs were unknown. The contigs were ordered by asm.align. Asm.align uses a number of relationships to identify and align contigs that are adjacent to each other. Using the algorithm, the 140 contigs were placed into 42 groups totaling 42 physical gaps (no template DNA for the region) and 98 sequence gaps (template available for gap closure).

Ordering Contigs Separated by Physical Gaps and Achieving Closure

Four integrated strategies were developed to order contigs separated by physical gaps. Oligonucleotide primers were designed and synthesized from the end of each contig group. These primers were then available for use in one or more of the strategies outlined below:

1. Southern analysis was done to develop a unique "fingerprint" for a subset of 72 of the above oligonucleotides. This procedure was based upon the supposition that labeled oligonucleotides homologous to the ends of adjacent contigs should hybridize to common DNA restriction fragments, and thus share a similar or identical hybridization pattern or "fingerprint". Oligonucleotides were labeled using 50 pmoles of each 20 mer and 250 mCl of $[\gamma-^{33}P]$ATP and T4 polynucleotide kinase. The labeled oligonucleotides were purified using Sephadex G-25 superfine (Pharmacia) and $10^7$ cpm of each was used in a Southern hybridization analysis of *H. influenzae* Rd chromosomal DNA digested with one frequent cutters (AseI) and five less frequent cutters (BglII, EcoRI, PstI, XbaI, and PvuII). The DNA from each digest was fractionated on a 0.7% agarose gel and transferred to Nytran Plus nylon membranes (Schleicher & Schuell). Hybridization was carried out for 16 hours at 40°. To remove non-specific signals, each blot was sequentially washed at room temperature with increasingly stringent conditions up to 0.1× SSC+0.5% SDS. Blots were exposed to a PhosphorImager cassette (Molecular Dynamics) for several hours and hybridization patterns were visually compared.

Adjacent contigs identified in this manner were targeted for specific PCR reactions.

2. Peptide links were made by searching each contig end using blasts (Altschul et al., *J. Mol. Biol.* 215:403 (1990)) against a peptide database. If the ends of two contigs matched the same database sequence in an appropriate manner, then the two contigs were tentatively considered to be adjacent to each other.

3. The two lambda libraries constructed from *H. influenaze* genomic DNA were probed with oligonucleotides designed from the ends of contig groups (Kirkness et al., *Genomics* 10:985 (1991)). The positive plaques were then used to prepare templates and the sequence was determined from each end of the lambda clone insert. These sequence fragments were searched using grasta against a database of all contigs. Two contigs that matched the sequence from the opposite ends of the same lambda clone were ordered. The lambda clone then provided the template for closure of the sequence gap between the adjacent contigs. The lambda clones were especially valuable for solving repeat structures.

4. To confirm the order of contigs found by the other approaches and establish the order of non-ordered contigs, standard and long range (XL) PCR reactions were performed as follows.

Standard PCR was performed in the following manner. Each reaction contained a 37 µl cocktail; 16.5 µl $H_2O$, 3 µl 25 mM $MgCl_2$, 8 µl of a dNTP mix (1.25 mM each dNTP), 4.5 µl 10× PCR core buffer II (Perkin Elmer), 25 ng *H. influenzae* Rd KW20 genomic DNA. The appropriate two primers (4 µl, 3.2 pmole/µl) were added to each reaction. A hot start was performed at 95° for 5 min followed by a 75° hold. During the hold Amplitaq DNA polymerase (Perkin Elmer) 0.3 µl in 4.3 µl $H_2O$, 0.5 µl 10× PCR core buffer II, was added to each reaction. The PCR profile was 25 cycles of 94°/45 sec., denature; 55°/1 min, anneal; 72°/3 min, extension. All reactions were performed in a 96 well format on a Perkin Elmer GeneAmp PCR System 9600.

Long range PCR (XL PCR) was performed as follows: Each reaction contained a 35.2 µl cocktail; 12.0 µl $H_2O$, 2.2 µl 25 mM $Mg(OAc)_2$, 4 µl of a dNTP mix (200 µM final concentration), 12.0 µl 3.3× PCR buffer, 25 ng *H. influenzae* Rd KW20 genomic DNA. The appropriate two primers (5 µl, 3.2 pmoles/µl) was added to each reaction. A hot start was performed at 94° for 1 minute. rTth polymerase, 2.0 µl (4 U/reaction) in 2.8 µl 3.3× PCR buffer II was added to each reaction. The PCR profile was 18 cycles of 94°/15 sec., denature; 62°/8 min., anneal and extend followed by 12 cycles 94°/15 sec., denature; 62°/8 min. (increase 15 sec./cycle), anneal and extend; 72°/10 min., final extension. All reactions were performed in a 96 well format on a Perkin Elmer GeneAmp PCR System 9600.

Although a PCR reaction was performed for essentially every combination of physical gap ends, techniques such as Southern fingerprinting, database matching, and the probing of large insert clones were particularly valuable in ordering contigs adjacent to each other and reducing the number of combinatorial PCR reactions necessary to achieve complete gap closure. Employing these strategies to an even greater extent in future genome projects will increase the overall efficiency of complete genome closure. The number of physical gaps ordered and closed by each of these techniques is summarized in Table 5.

Figure 5:
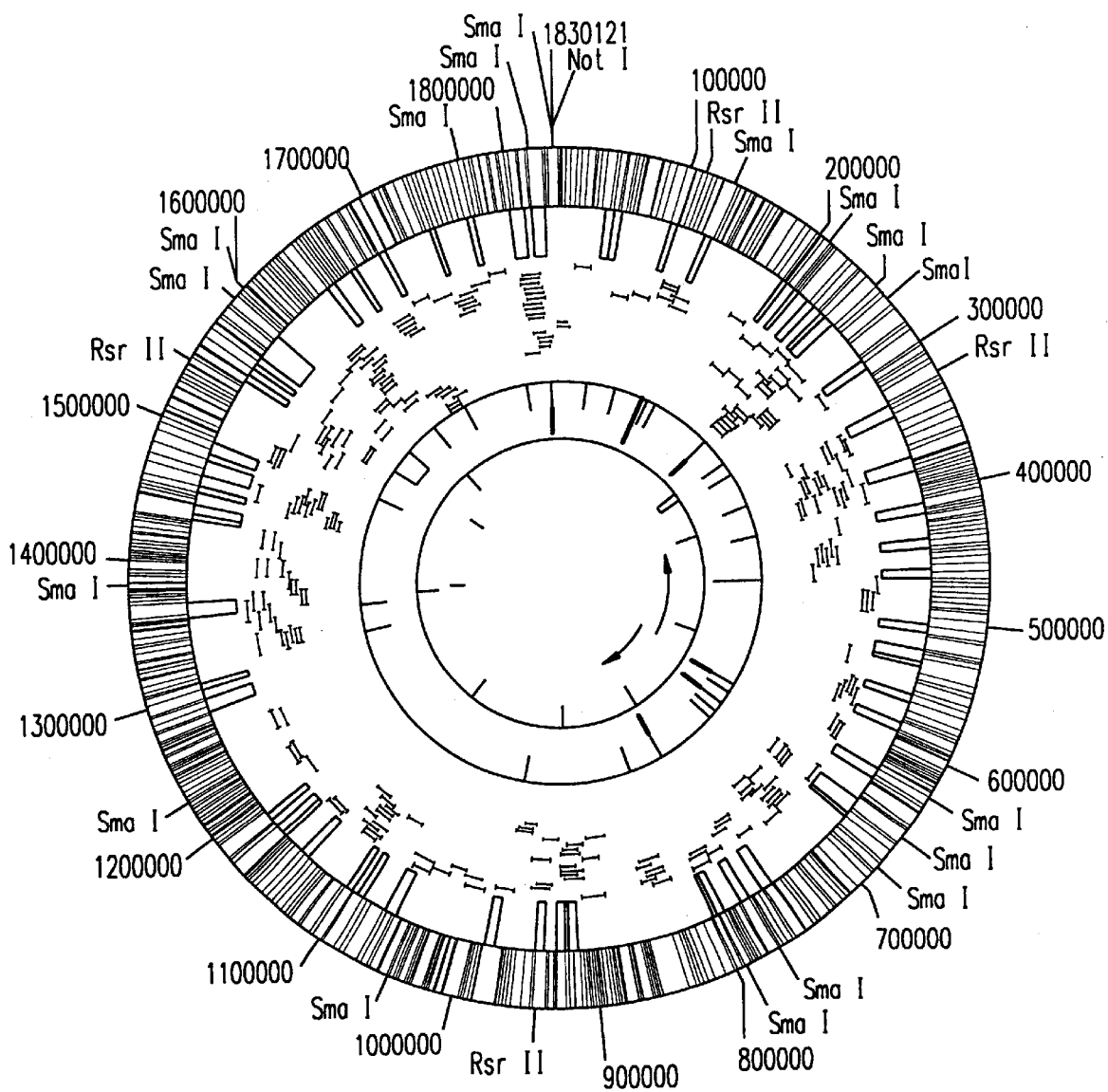
FIG. 5—A circular representation of the *H. influenzae* Rd chromosome illustrating the location of each predicted coding region containing a database match as well as selected global features of the genome. Outer perimeter: The location of the unique NotI restriction site (designated as nucleotide I), the RsrII sites, and the SmaI sites. Outer concentric circle: The location of each identified coding region for which a gene identification was made. Each coding region location is coded as to role in FIG. 6A–6N. Second concentric circle: Regions of high G/C content and high A/T content. High G/C content regions are specifically associated with the 6 ribosomal operons and the mu-like prophage. Third concentric circle: Coverage by lambda clones. Over 300 lambda clones were sequenced from each end to confirm the overall structure of the genome and identify the 6 ribosomal operons. Fourth concentric circle: The locations of the 6 ribosomal operons, the tRNAs and the cryptic mu-like prophage. Fifth concentric circle: Simple tandem repeats. The locations of the following repeats are shown: CTGGCT, GTCT, ATT, AATGGC, TTGA, TTGG, TTTA, TTATC, TGACC, TCGTC, AACC, TTGC, CAAT, CCAA. The putative origin of replication is illustrated by the outward pointing arrows originating near base 603,000. Two potential termination sequences are shown near the opposite midpoint of the circle.

Sequence information from the ends of 15–20 kb clones is particularly suitable for gap closure, solving repeat structures, and providing general confirmation of the overall genome assembly. We were also concerned that some fragments of the *H. influenaze* genome would be non-clonable in a high copy plasmid in *E. coli*. We reasoned that lytic lambda clones would provide the DNA for these segments. Approximately 100 random plaques were picked from the amplified lambda library, templates prepared, and sequence information obtained from each end. These sequences were searched (grasta) against the contigs and linked in the database to their appropriate contig, thus providing a scaffolding of lambda clones contributing additional support to the accuracy of the genome assembly (FIG. 5). In addition to confirmation of the contig structure, the lambda clones provided closure for 23 physical gaps. Approximately 78% of the genome is covered by lambda clones.

Lambda clones were also useful for solving repeat structures. Repeat structures identified in the genome were small enough to be spanned by a single clone from the random insert library, except for the six ribosomal RNA operons and one repeat (2 copies) which was 5,340 bp in length. Oligonucleotide probes were designed from the unique flanks at the beginning of each repeat and hybridized to the lambda libraries. Positive plaques were identified for each flank and the sequence fragments from the ends of each clone were used to correctly orient the repeats within the genome.

The ability to distinguish and assemble the six ribosomal RNA (rRNA) operons of *H. influenaze* (16S subunit-23S subunit-5S subunit) was a test of our overall strategy to sequence and assemble a complex genome which might contain a significant number of repeat regions. The high degree of sequence similarity and the length of the six operons caused the assembly process to cluster all the underlying sequences into a few indistinguishable contigs. To determine the correct placement of the operons in the sequence, a pair of unique flanking sequences was required for each. No unique flanking sequences could be found at the left (16S rRNA) ends. This region contains the ribosomal promoter and appeared to be non-clonable in the high copy number pUC18 plasmid. However, unique sequences could be identified at the right (5S) ends. Oligonucleotide primers were designed from these six flanking regions and used to probe the two lambda libraries. For each of the six rRNA operons at least one positive plaque was identified which completely spanned the rRNA operon and combined unique flanking sequence at the 16S and 5S ends. These plaques provided the templates for obtaining the unique sequence for each of the six rRNA operons.

An additional confirmation of the global structure of the assembled circular genome was obtained by comparing a computer generated restriction map based on the assembled sequence for the enzymes ApaI, SmaI, and RsrII with the predicted physical map of Redfield and Lee (*Genetic Maps: locus maps of complex genomes*, S. J. O'Brien, Ed. Cold Spring Harbor Laboratory Press, New York, N.Y., 1990, 2110.). The restriction fragments from the sequence-derived map matched those from the physical map in size and relative order (FIG. 5).

Editing

Simultaneous with the final gap filling process, each contig was edited visually by reassembling overlapping 10 kb sections of contigs using the AB AutoAssembler™ and the First Data Finder™ hardware. AutoAssembler™ provides a graphical interface to electropherogram data for editing. The electropherogram data was used to assign the most likely base at each position. Where a discrepancy could not be resolved or a clear assignment made, the automatic base calls were left unchanged. Individual sequence changes were written to the electropherogram files and a replication protocol (crash) was used to maintain the synchrony of sequence data between the *H. influenzae* database and the electropherogram files. Following editing, contigs were reassembled with TIGR Assembler prior to annotation.

Potential frameshifts identified in the course of annotating the genome were saved as reports in the database. These reports include the coordinates in a contig which the alignment software (praze) predicts to be the most likely location of a missing or inserted base and a representation of the sequence alignment containing the frameshift. Apparent frameshifts were used to indicate areas of the sequence which may require further editing. Frameshifts were not corrected in cases where clear electropherogram data disagreed with a frameshift. Frameshift editing was performed with TIGR Editor.

The rRNA and other repeat regions precluded complete assembly of the circular genome with TIGR Assembler. Final assembly of the genome was accomplished using comb_asm which splices together contigs based on short overlaps.

Accuracy of the Genome Sequence

The accuracy of the *H. influenaze* genome sequence is difficult to quantitate because there is very little previously determined *H. influenaze* sequence and most of these sequences are from other strains. There are, however, three parameters of accuracy that can be applied to the data. First, the number of apparent frameshifts in predicted *H. influenaze* genes, based on database similarities, is 148. Some of these apparent frameshifts may be in the database sequences rather than in ours, particularly considering that 49 of the apparent frameshifts are based on matches to hypothetical proteins from other organisms. Second, there are 188 bases in the genome that remain as N ambitguities (1/9,735 bp). Combining these two types of "known" errors, we can calculate a maximum sequence accuracy of 99.98%. The average coverage is 6.5× and less than 1% of the genome is single-fold coverage.

Identifying Genes

An attempt was made to predict all of the coding regions of the *H. influenzae* Rd genome and identify genes, tRNAs and rRNAs, as well as other features of the DNA sequence (e.g., repeats, regulatory sites, replication origin sites, nucleotide composition). A description of some of the readily apparent sequence features is provided below.

The *H Influenaze* Rd genome is a circular chromosome of 1,830,121 bp. The overall G/C nucleotide content is approximately 38% (A=31%, C=19%, G=19%, T=31%, IUB=0.035%). The G/C content of the genome was examined with several window lengths to look for global structural features. With a window of 5,000 bp, the G/C content is relatively even except for 7 large G/C-rich regions and several A/T-rich regions (FIG. 5). The G/C rich regions correspond to six rRNA operons and the location of a cryptic mu-like prophage. Genes for several proteins with similarity to proteins encoded by bacteriophage mu are located at approximately position 1.56–1.59 Mbp of the genome. This area of the genome has a markedly higher G/C content than average for *H. influenaze* (~50% G/C compared to ~38% for the rest of the genome). No significance has yet been ascertained for the source or importance of the A/T rich regions.

The minimal origin of replication (oriC) in *E. coli* is a 245 bp region defined by three copies of a thirteen base pair repeat containing a GATC core sequence at one end and four copies of a nine base pair repeat containing a TTAT core sequence at the other end. The GATC sites are methylation targets and control replication while the TTAT sites provide the binding sites for DnaA, the first step in the application process (*Genes* V. B. Lewin Ed. (Oxford University Press, N.Y., 1994), chap. 18–19). An approximately 281 bp sequence (602,483–602,764) whose limits are defined by these same core sequences appears to define the origin of replication in *H Influenaze* Rd. These coordinates lie between sets of ribosomal operons rrnF, rrnE, rrnD and rrnA, rrnB, rrnC. These two groups of ribosomal operons are transcribed in opposite directions and the placement of the origin is consistent with their polarity for transcription. Termination of *E. coli* replication is marked by two 23 bp termination sequences located ~100 kb on either side of the midway point at which the two replication forks meet. Two potential termination sequences sharing a 10 bp core sequence with the *E. coli* termination sequence were identified in *H. Influenaze* at coordinates 1,375,949–1,375,958 and 1,558,759–1,558,768. These two sets of coordinates are offset approximately 100 kb from the point 180° opposite of the proposed origin of *H. influenaze* replication.

Six rRNA operons were identified. Each rRNA operon contains three rRNA subunits and a variable spacer region in the order: 16S—spacer region—23S subunit—5S subunit. The subunit lengths are 1539 bp, 2653 bp, and 116 bp, respectively. The G/C content of the three ribosomal subunits (50%) is higher than the genome as a whole. The G/C content of the spacer region (38%) is consistent with the remainder of the genome. The nucleotide sequence of the three rRNA subunits is 100% identical in all six ribosomal operons. The rRNA operons can be grouped into two classes based on the spacer region between the 16S and 23S sequences. The shorter of the two spacer regions is 478 bp in length (rrnB, rrnE, and rrnF) and contents of gene for tRNA Glu. The longer spacer is 723 bp in length (rrnA, rrnC, and RRnD) and contains the genes for tRNA Ile and tRNA Ala. The two sets of spacer regions are also 100% identical across each group of three operons. tRNA genes are also present at the 16S and 5S ends of two of the rRNA operons. The genes for tRNA Arg, tRNA His, and tRNA Pro are located at the 16S end of rnnE while the genes for tRNA Trp, and tRNA Asp are located at the 5S end of rrnA.

The predicted coding regions of the *H influenaze* genome were initially defined by evaluating their coding potential with the program Genemark (Borodovsky and McInich, *Computers Chem* 17(2):123 (1993)) using codon frequency matrices derived from 122 *H. influenzae* coding sequences in Genbank. The predicted coding region sequences (plus 300 bp of flanking sequence) were used in searches against a database of non-redundant bacterial proteins (NRSP) created specifically for the annotation. Redundancy was removed from NRBP at two stages. All DNA coding sequences were extracted from GenBank (release 85), and sequences from the same species were searched against each other. Sequences having >97% similarity over regions >100 nucleotides were combined. In addition, the sequences were translated and used in protein comparisons with all sequences in Swiss-Prot (release 30). Sequences belonging to the same species and having >98% similarity over 33 amino acids were combined. NRBP is composed of 21,445 sequences extracted from 23,751 GenBank sequences and 11,183 Swiss-Prot sequences from 1,099 different species.

A total of 1,749 predicted coding regions were identified. Searches of the *H. influenaze* predicted coding regions were performed using an algorithm that translates the query DNA sequences in the three plus-strand reading frame for searching against NRBP, identifies the protein sequences that match the query, and aligns the protein-protein matches using prase, a modified Smith-Waterman (Pearson and Lipman, *Proc. Natl. Acad. Sci. U.S.A.* 85:2444 (1988)) algorithm. In cases where insertion or deletions in the DNA sequence produced a frameshift error, the alignment algorithm started with protein regions of maximum similarity and extended the alignment to the same database match in alternative frames using the 300 bp flanking region. Regions known to contain frameswft errors were saved in the database and evaluation for possible correction. Unidentified predicted coding regions and the remaining intergenic sequences were searched against a dataset of all available peptide sequences from Swiss-Prot, PIR, and GenBank. Identification of operon structures will be facilitated by experimental determination of transcription promoter and termination sites.

Each putatively identified *H. influenaze* gene was assigned to one of 102 biological role categories adapted from Riley (Riley, M., *Microbiology Reviews* 57(4):862 (1993)). Assignments were made by linking the protein sequence of the predicted coding regions with the Swiss-Prot sequences in the Riley database. Of the 1,749 predicted coding regions, 724 have no role assignment. Of these, no database match was found for 384, while 340 matched "hypothetical proteins" in the database. Role assignments were made for 1,025 of the predicted coding regions. A compilation of all the predicted coding regions, their unique identifiers, a three letter gene identifier, percent identity, percent similarity, and amino acid match length are presented in Table 1(a).

Figure 6A:
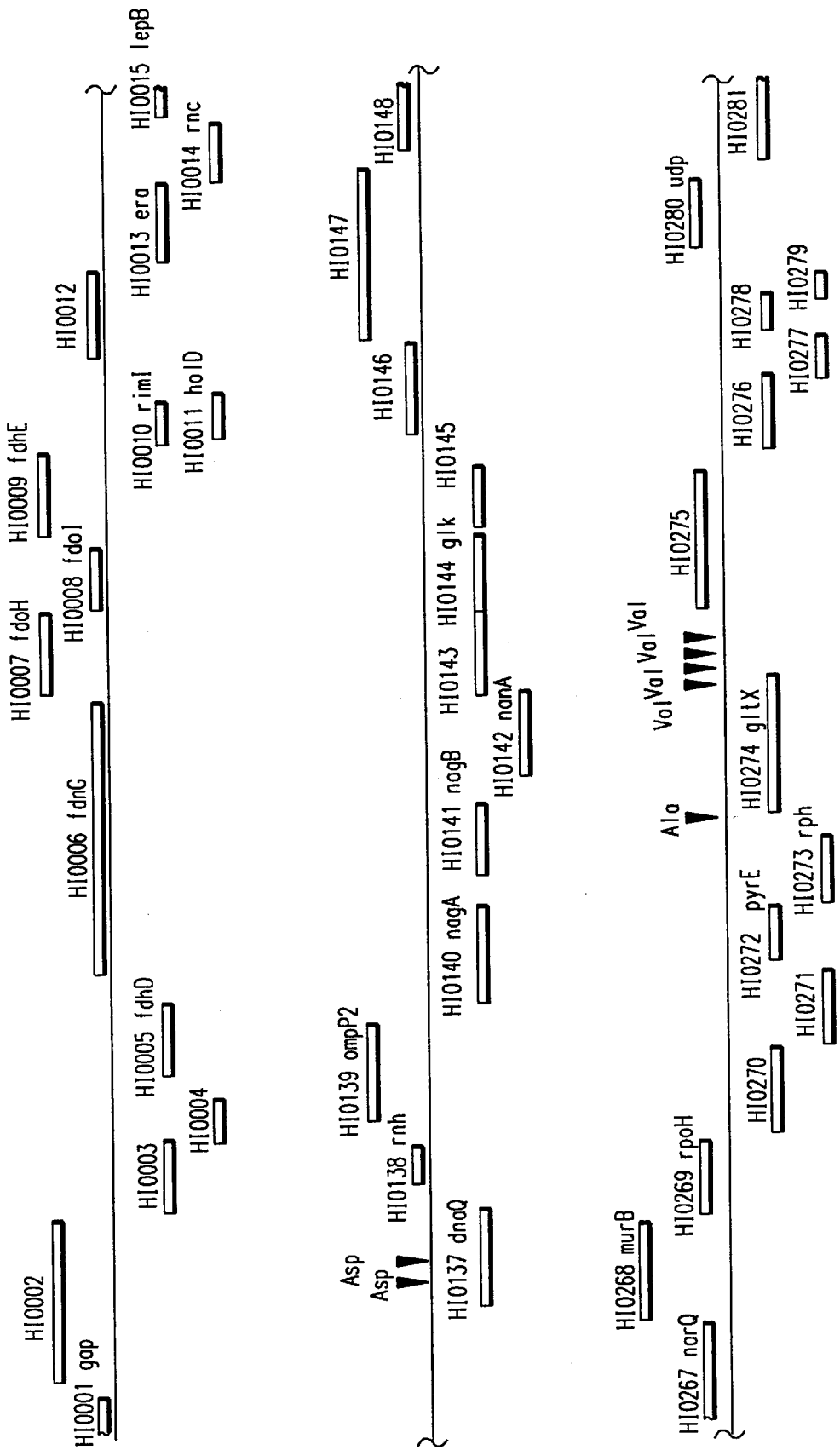
FIGS. 6A–6N Complete map of the *H. influenzae* Rd genome. Predicated coding regions are shown on each strand. rRNA and tRNA genes are shown in lines and triangles, respectively. GeneID numbers correspond to those in Tables 1(*a*), 1(*b*) and 2. Where possible, three-letter designations are also provided.
Figure 6B:
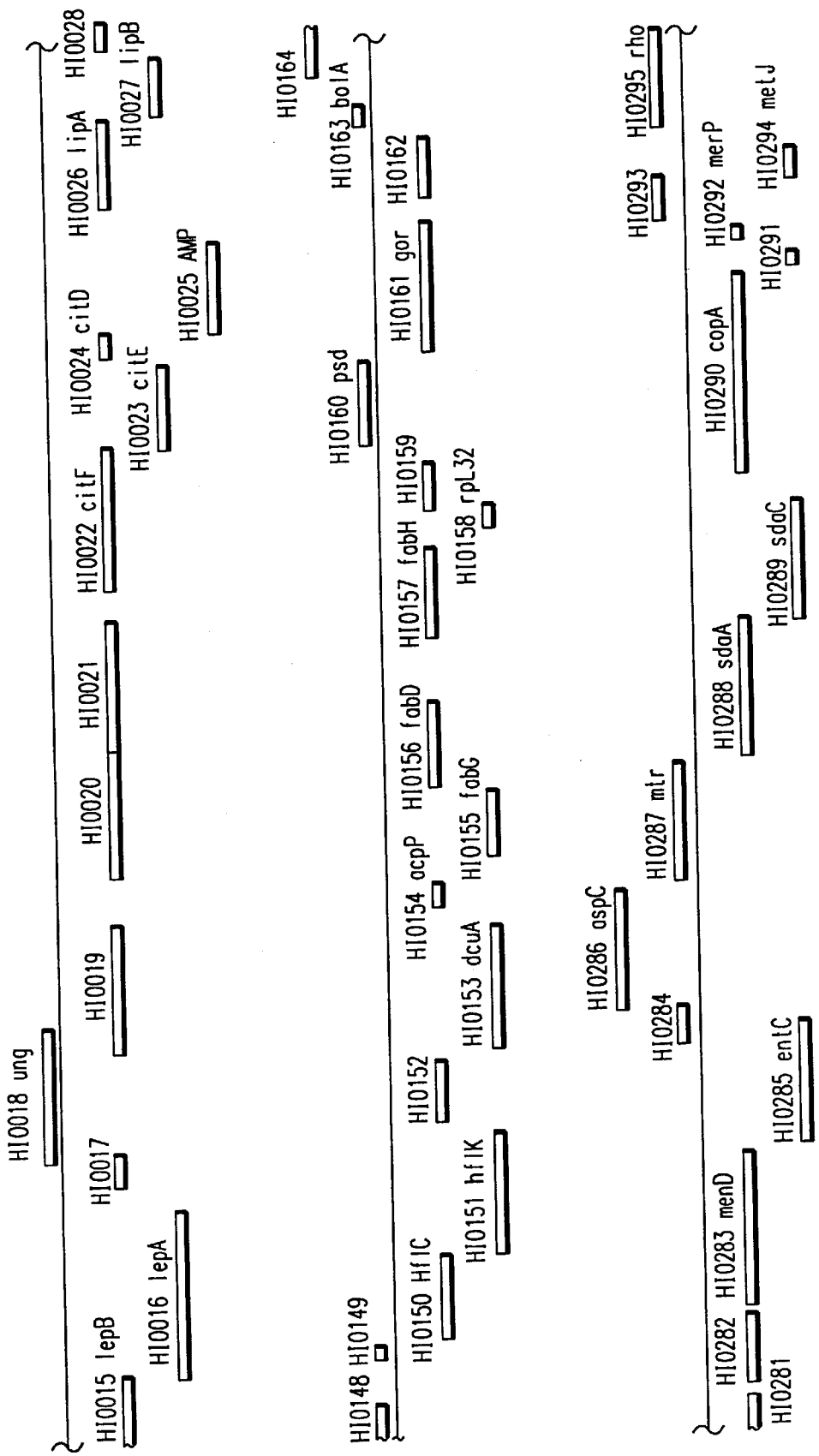
Figure 6C:
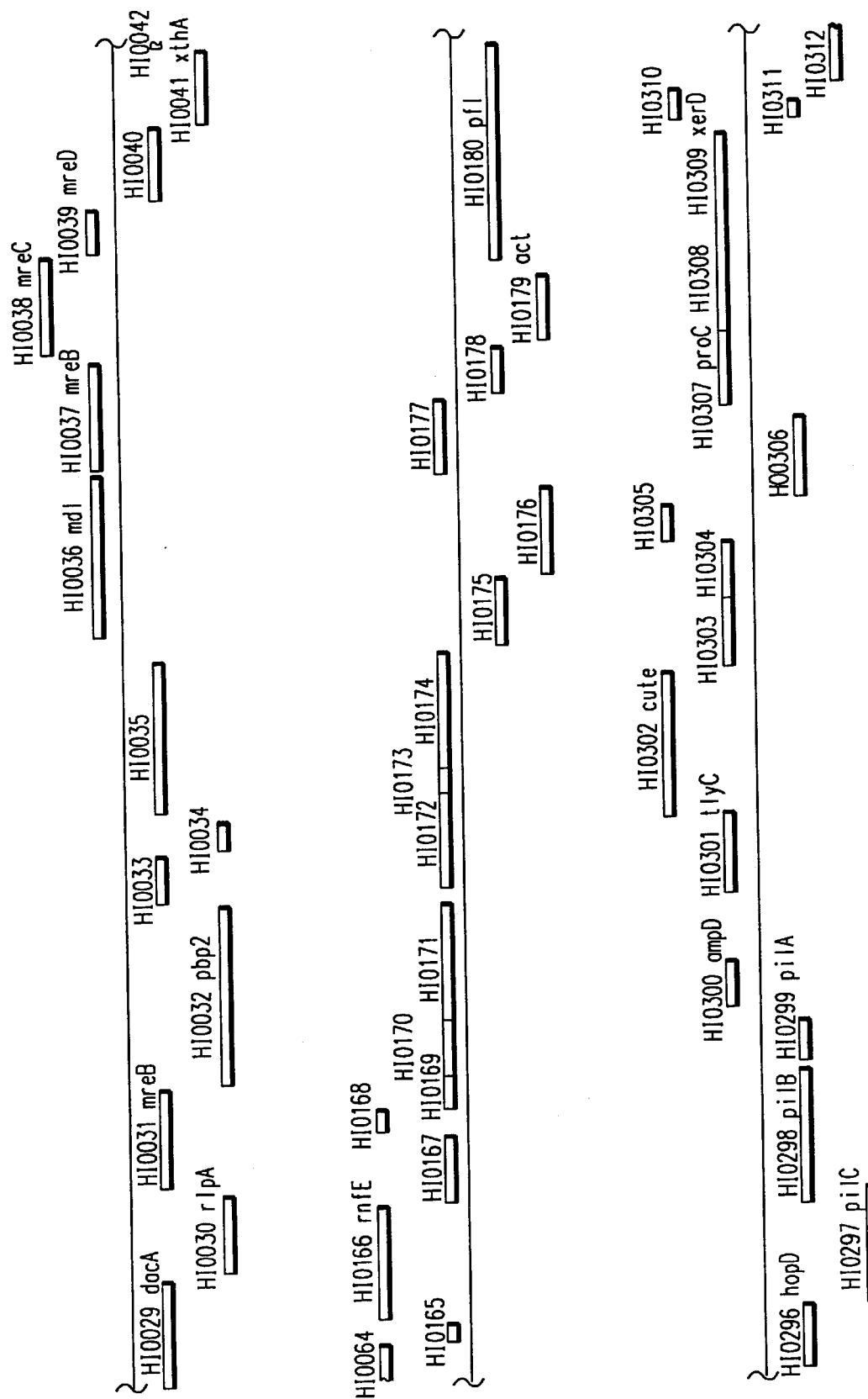
Figure 6D:
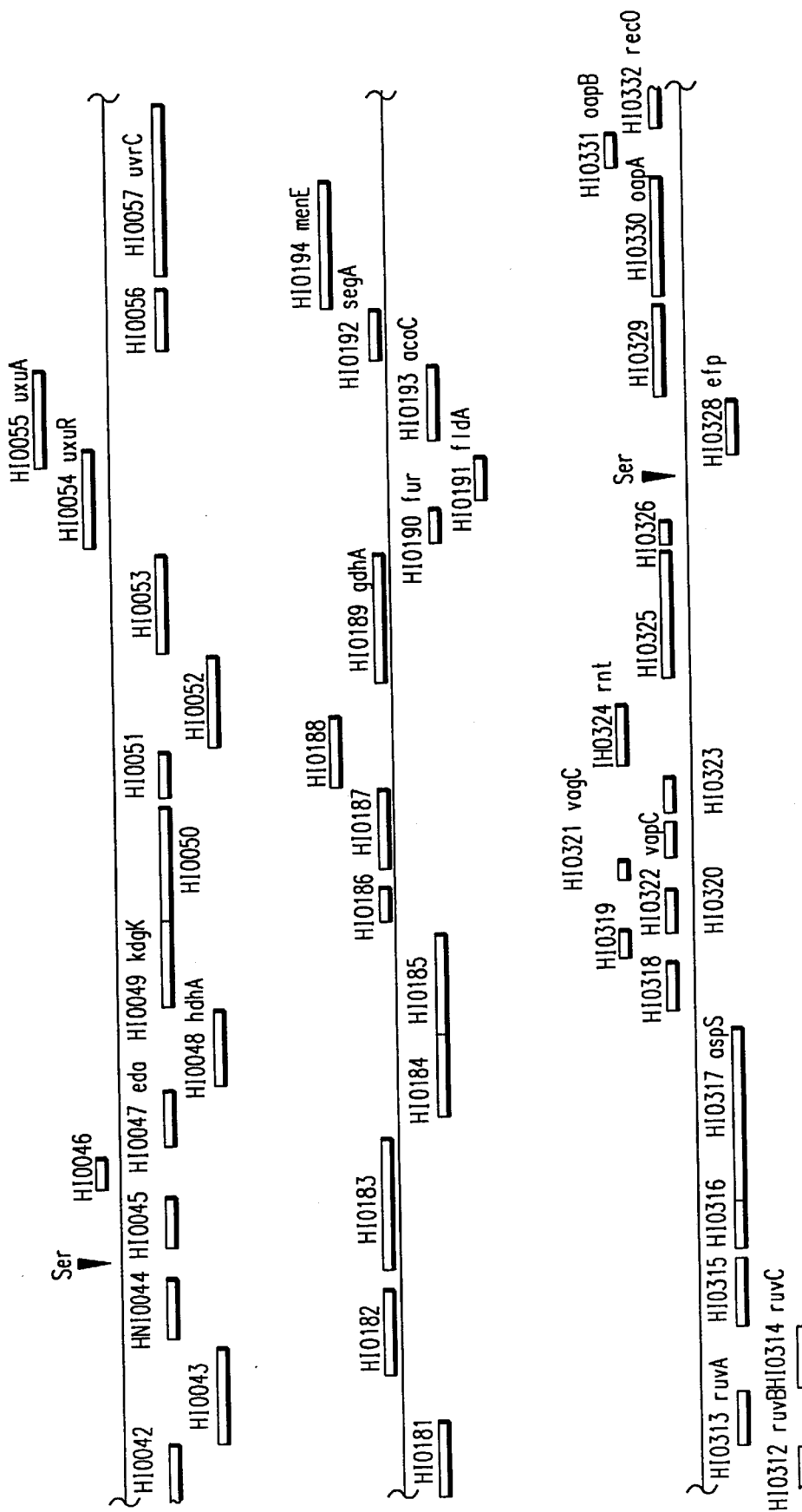
Figure 6E:
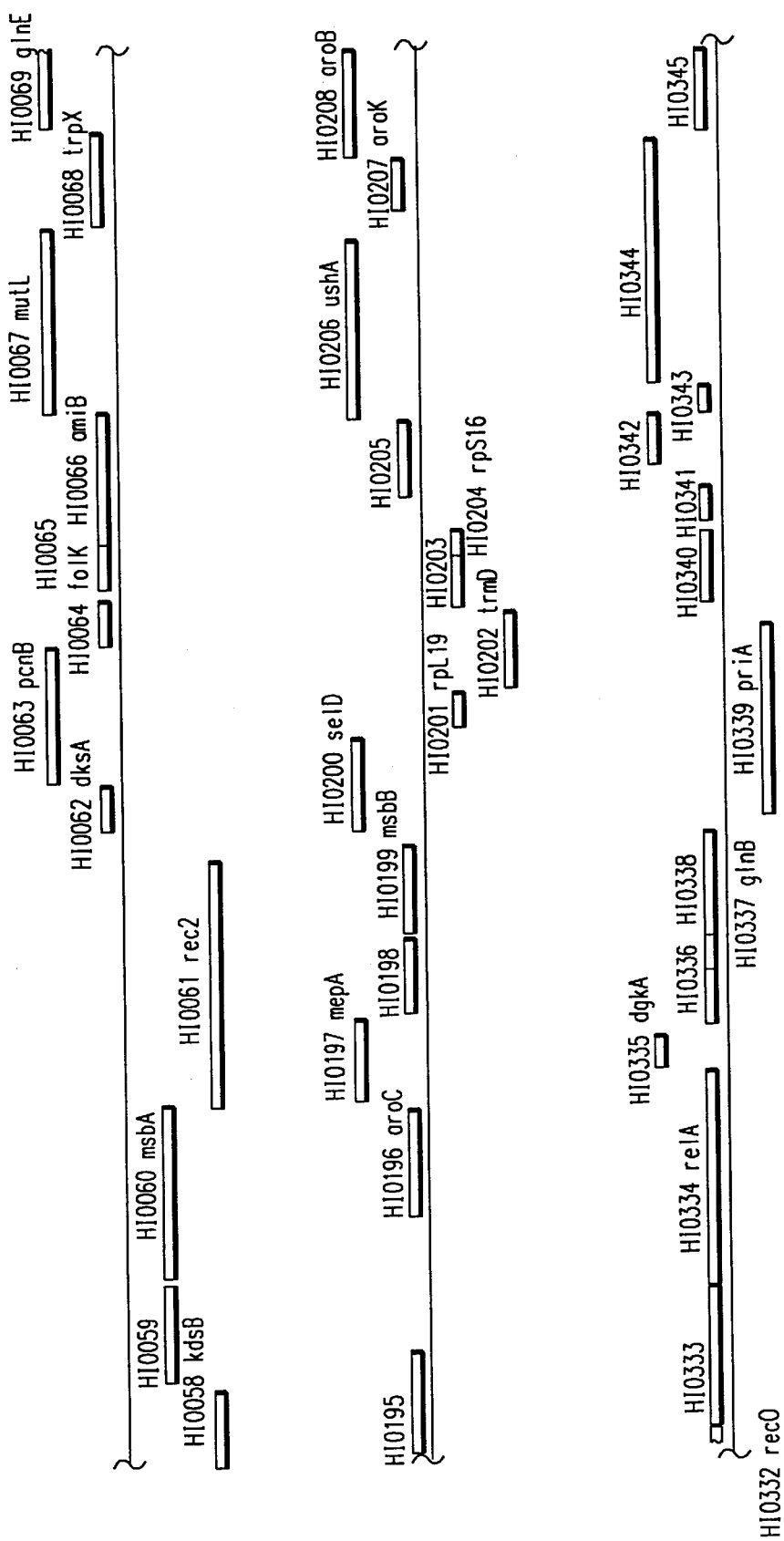
Figure 6F:
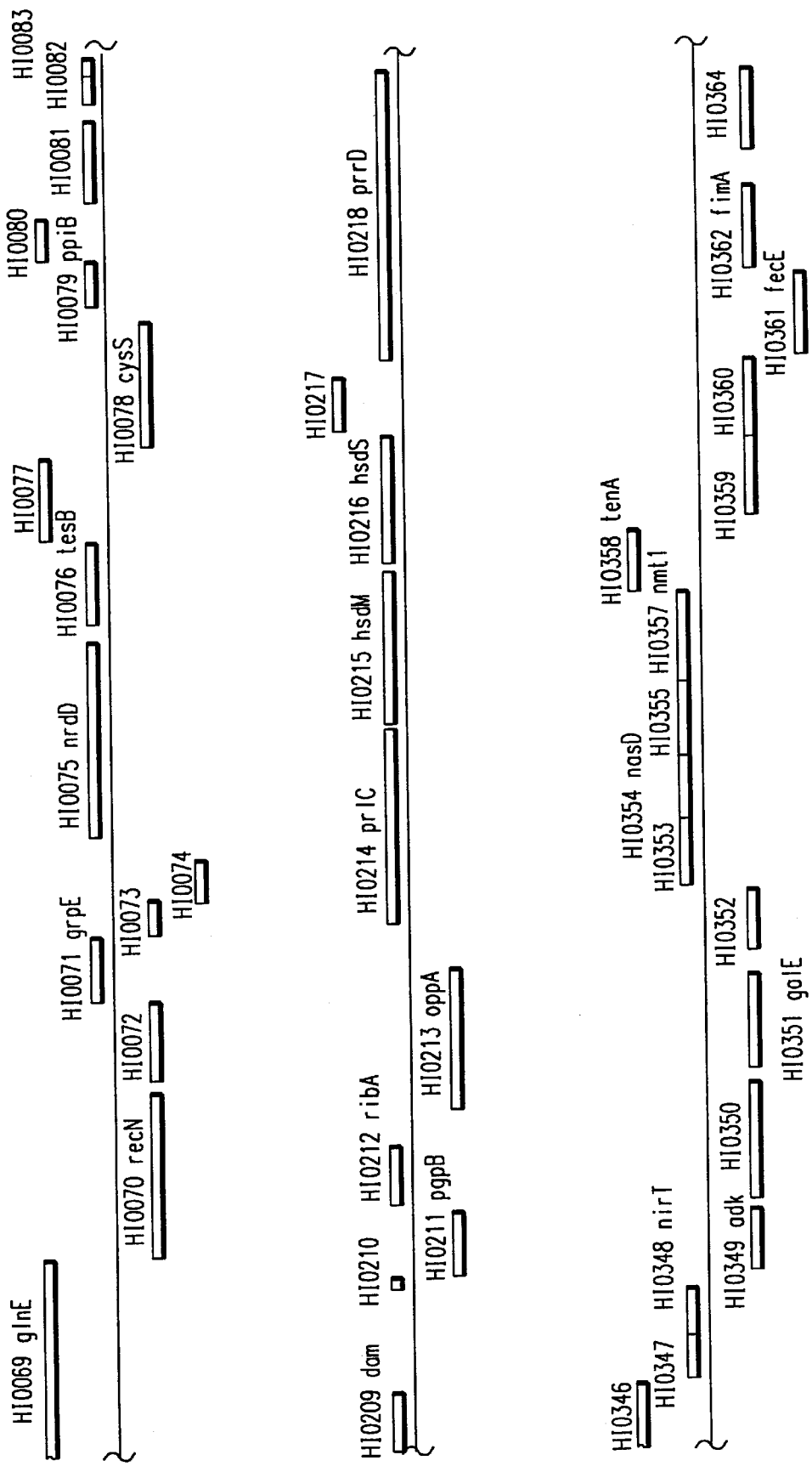
Figure 6G:
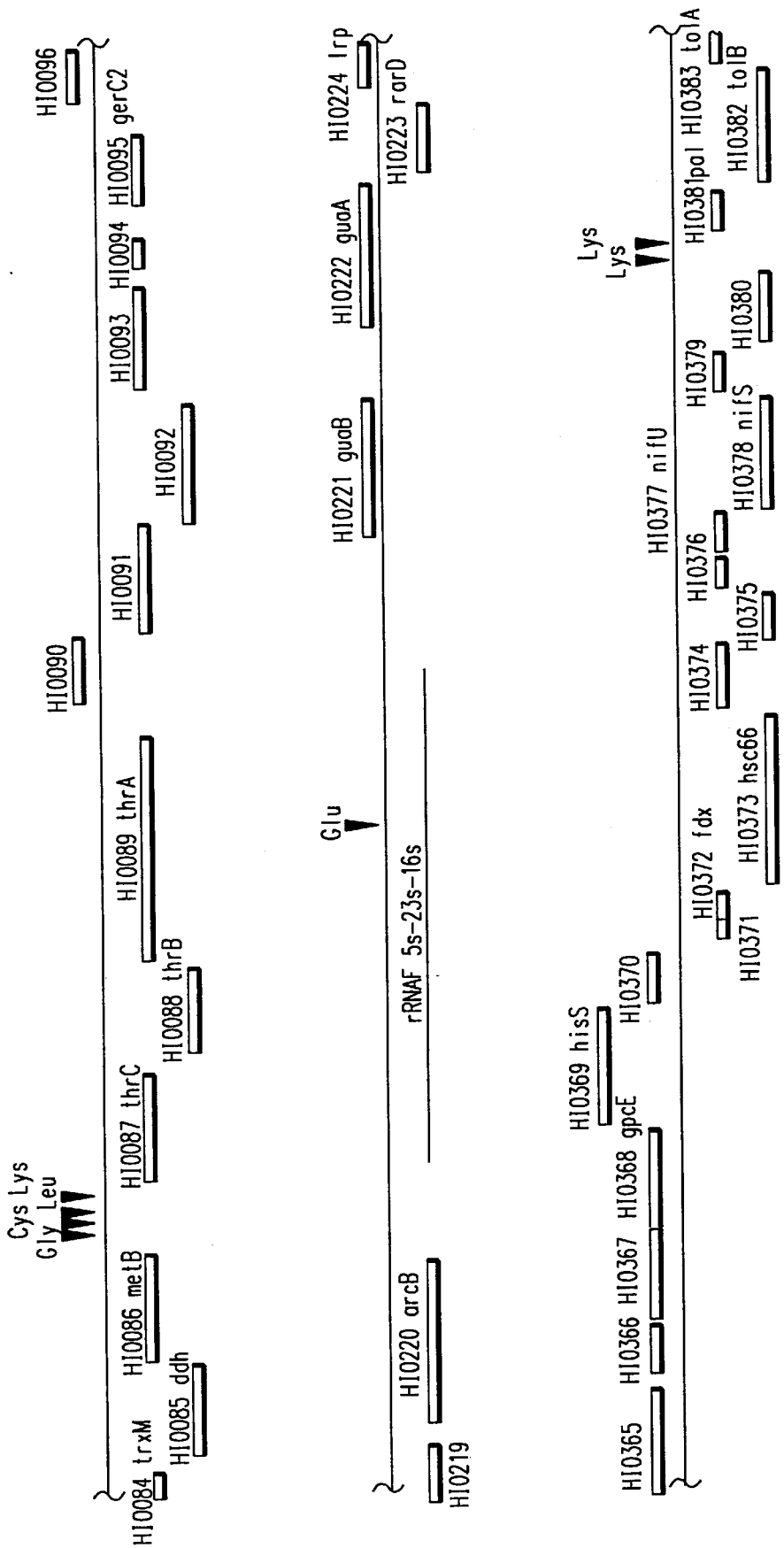
Figure 6H:
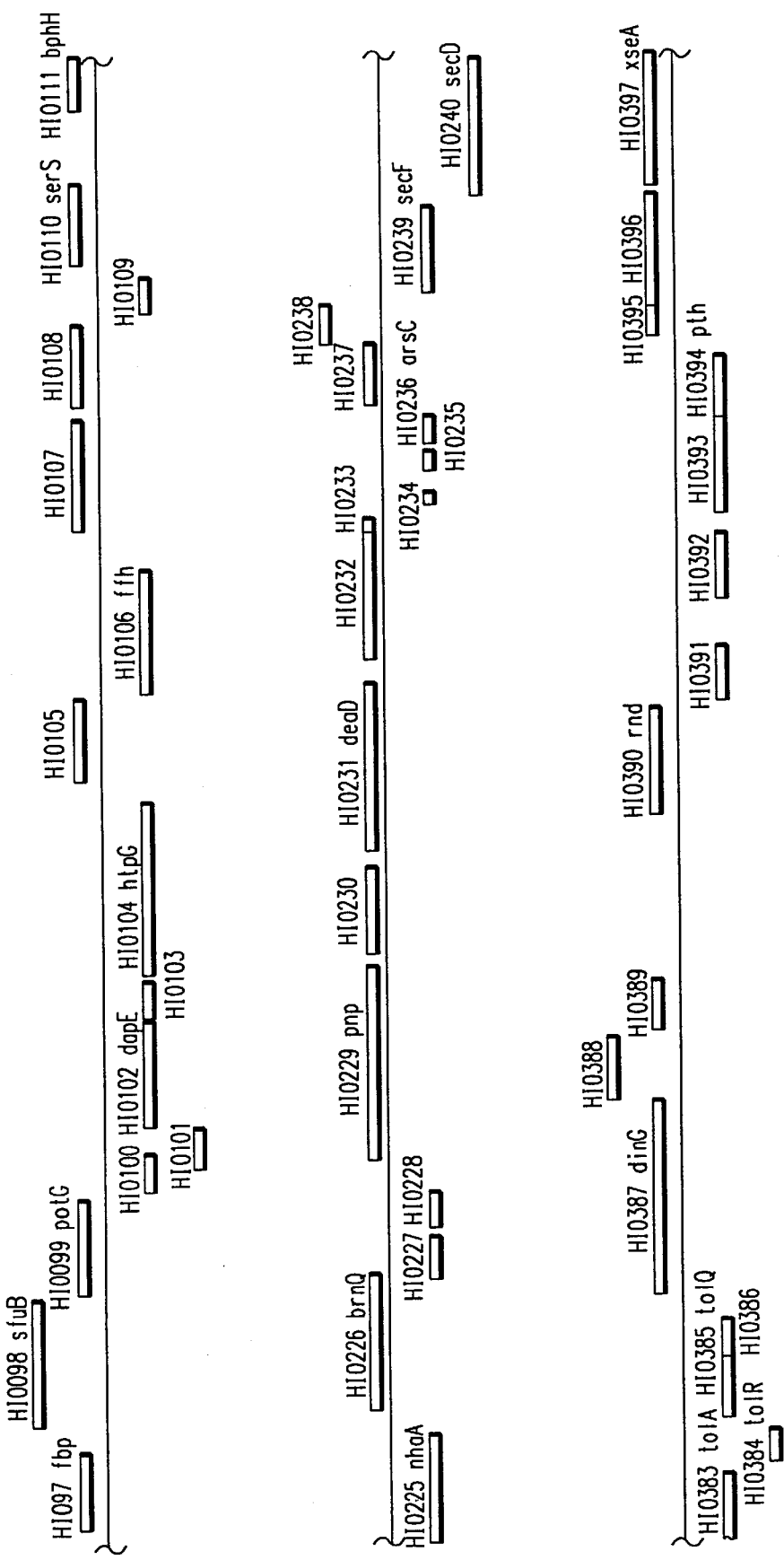
Figure 61:
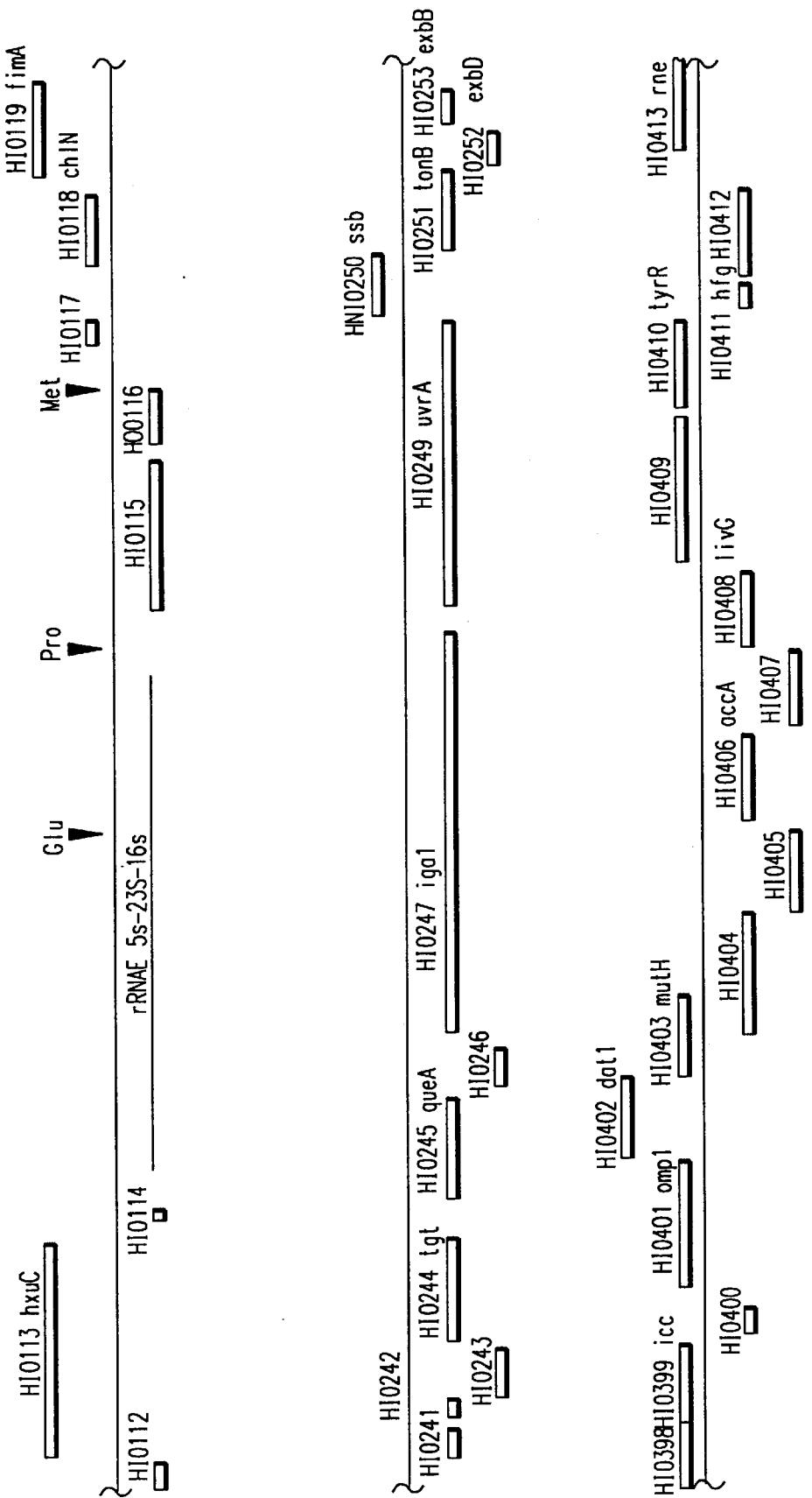
Figure 6J:
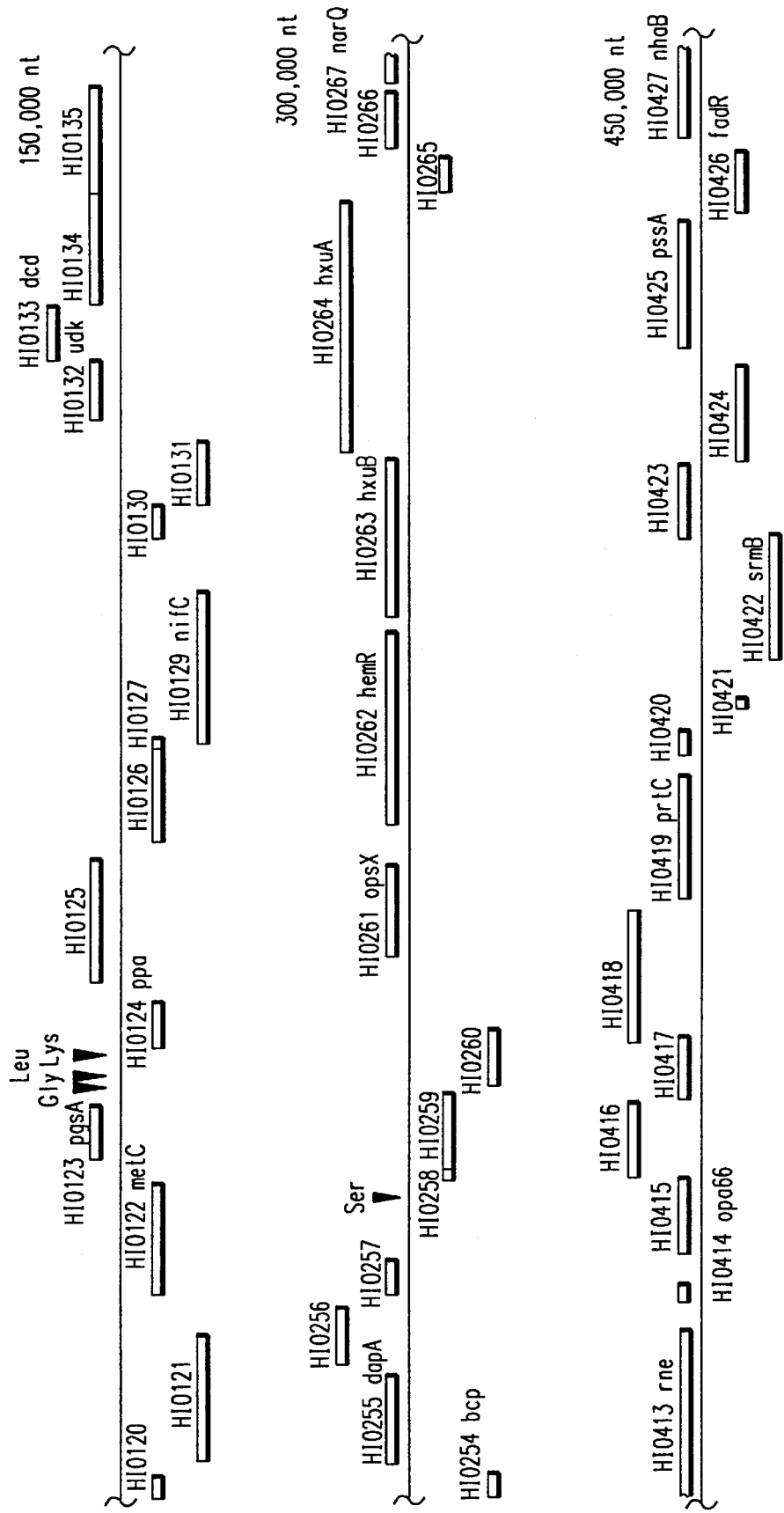
Figure 6K:
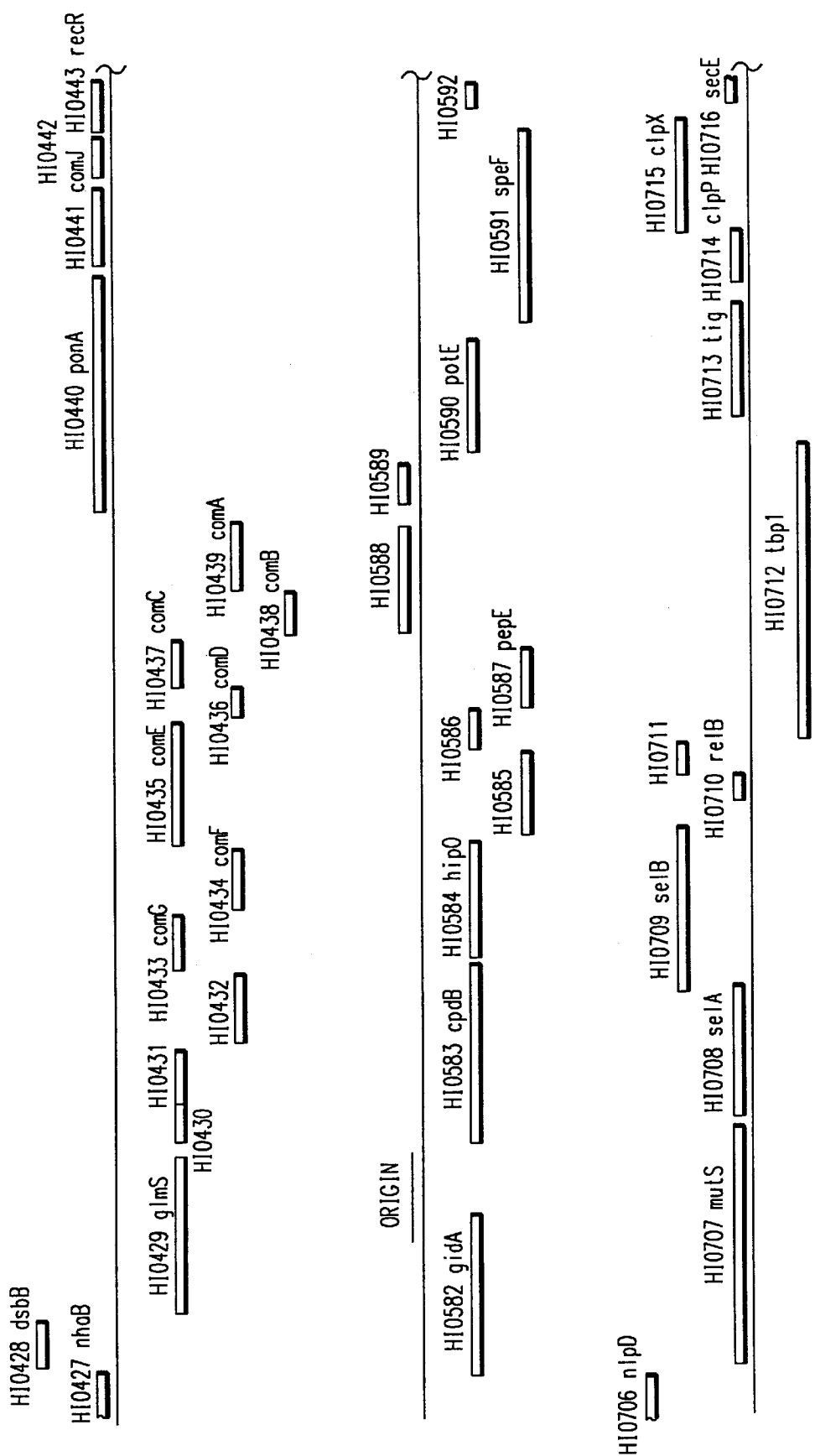
Figure 6L:
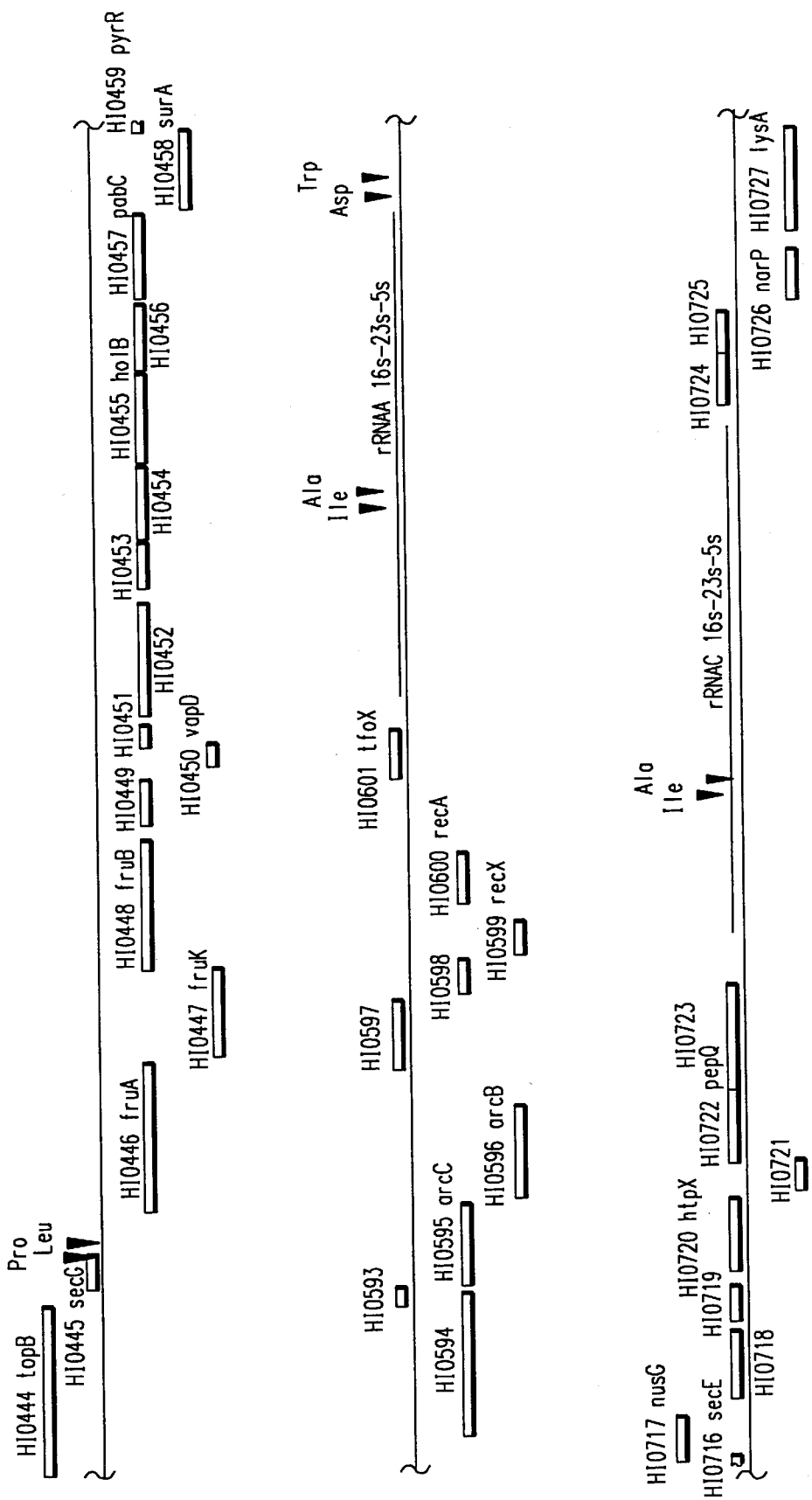
Figure 6M:
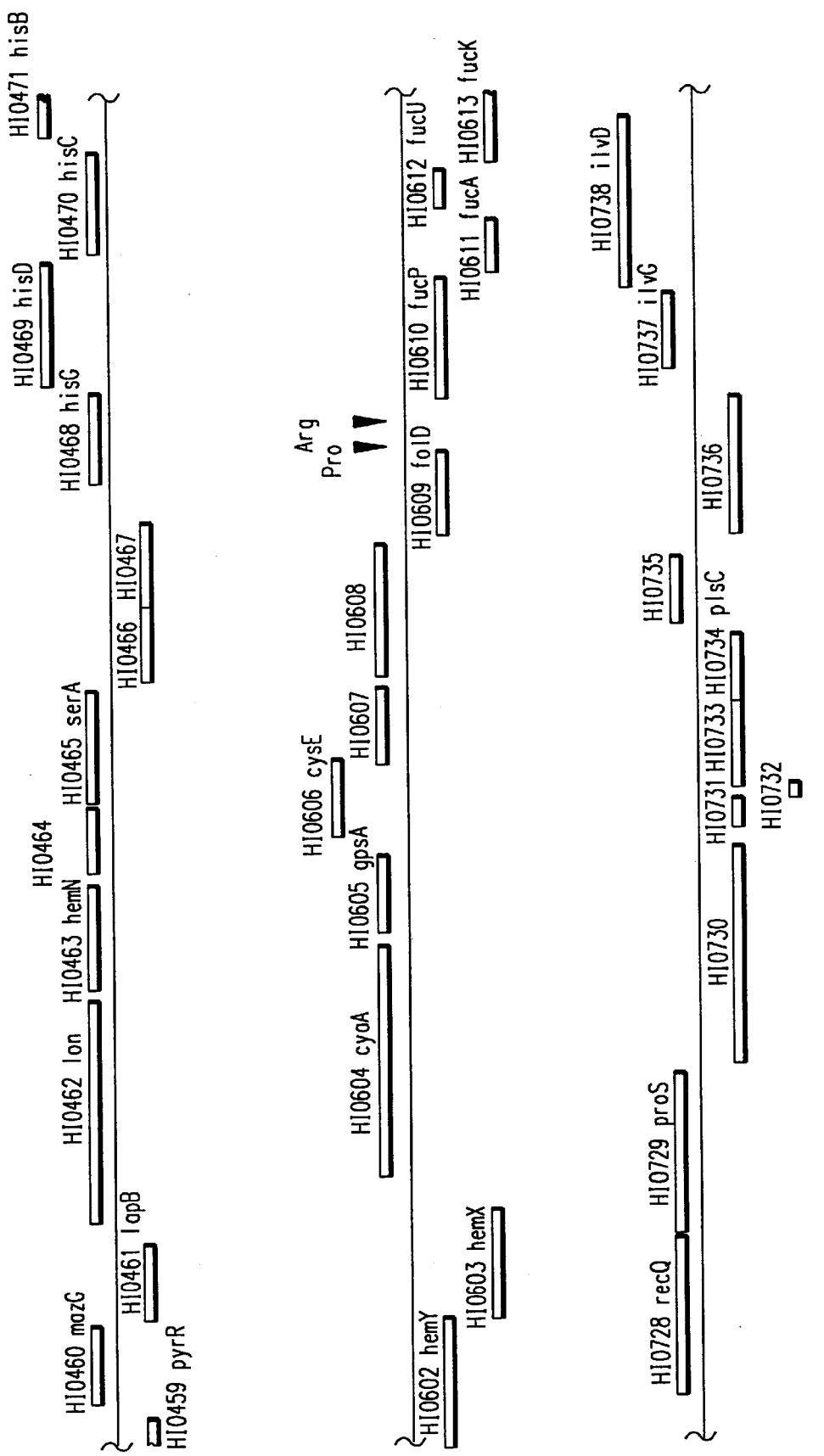
Figure 6N:
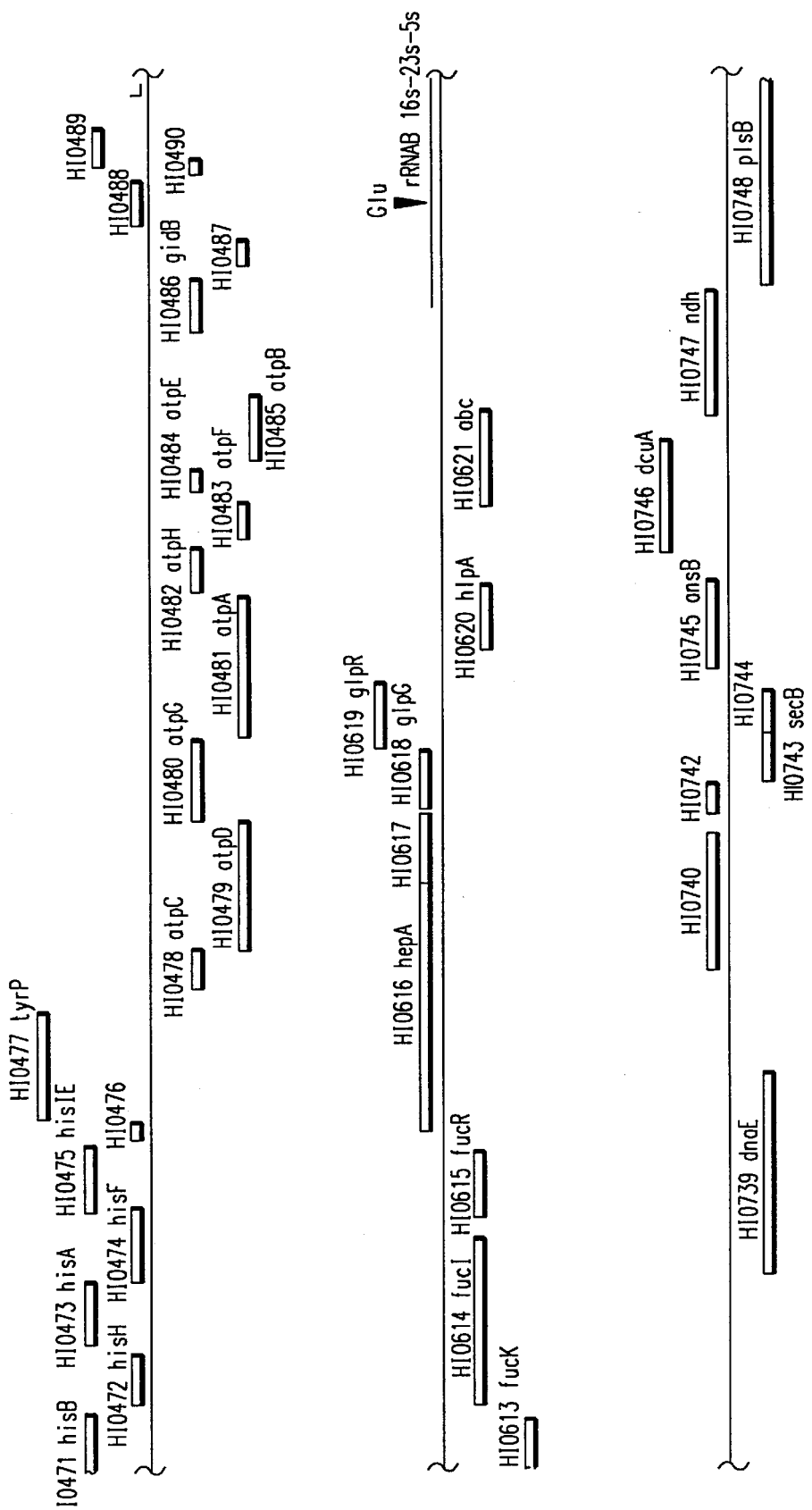
Figure 60:
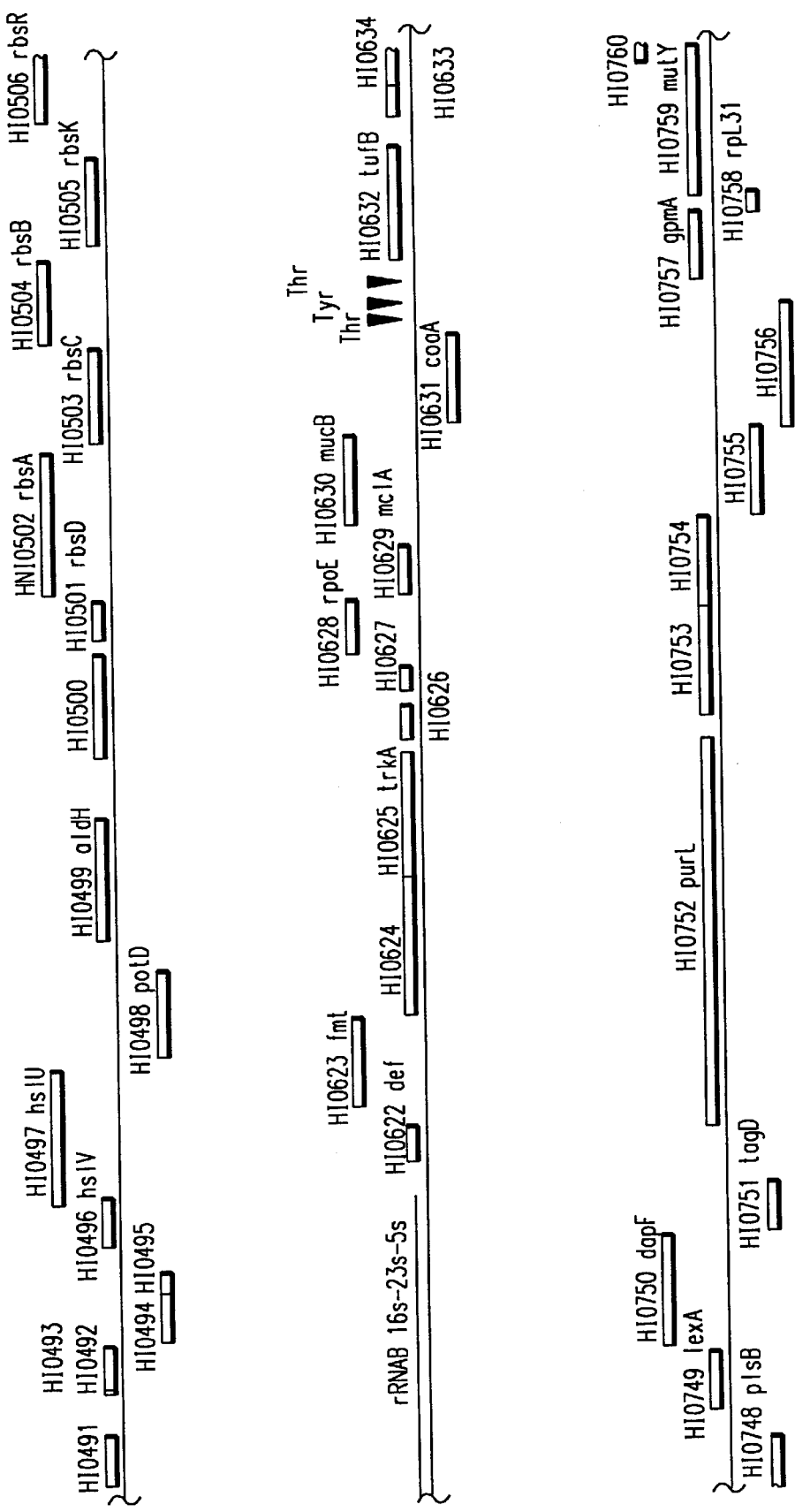
Figure 6P:
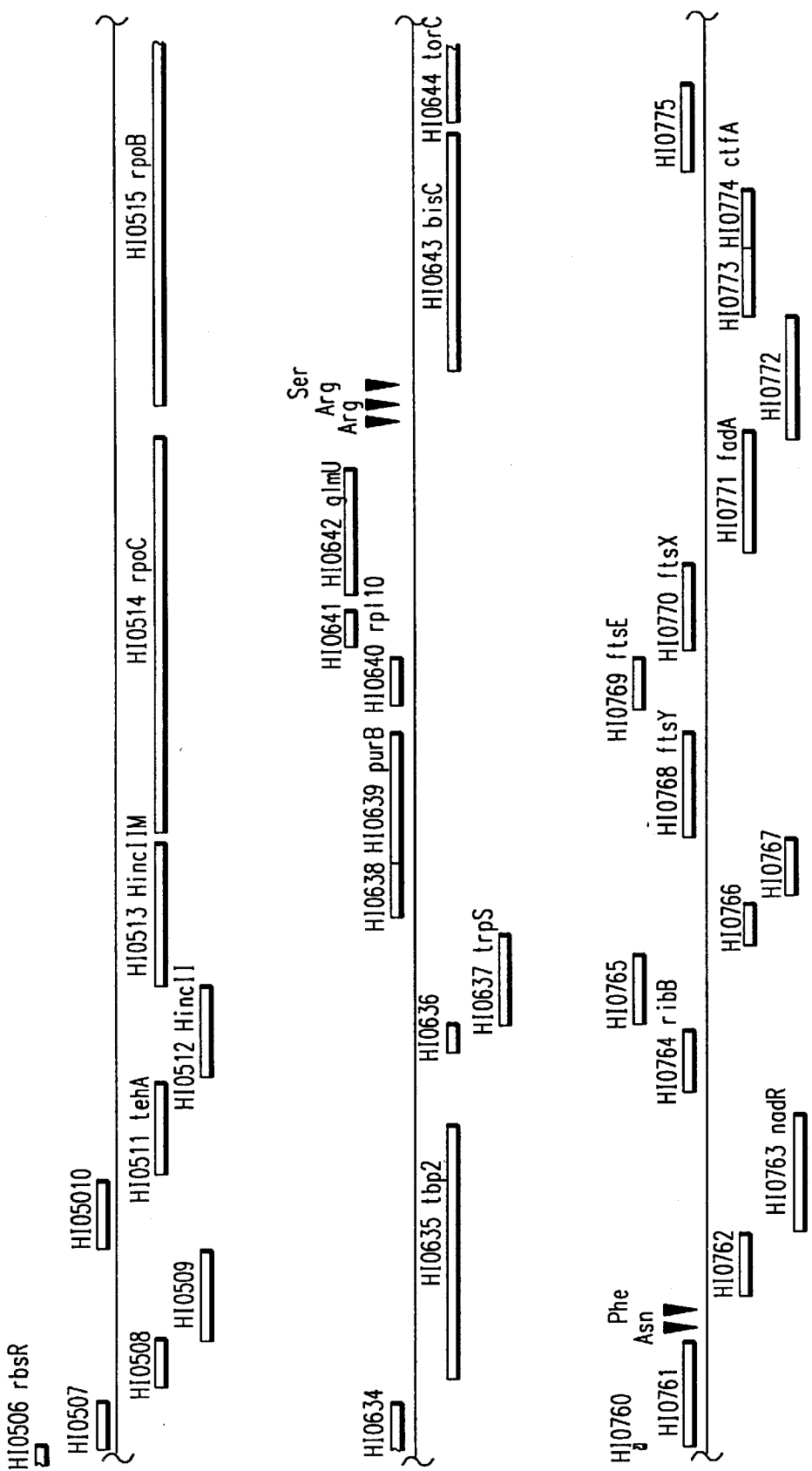
Figure 6Q:
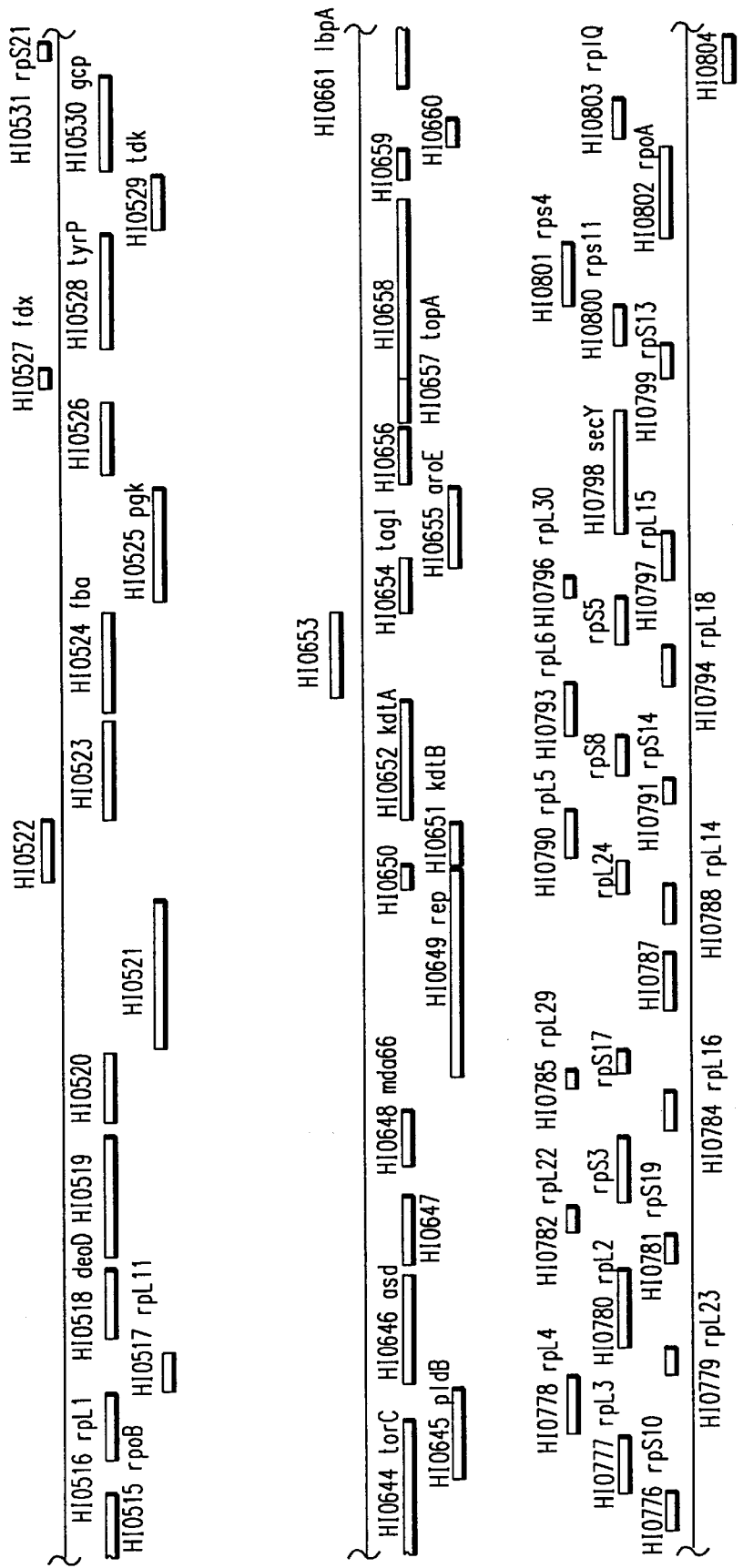
Figure 6R:
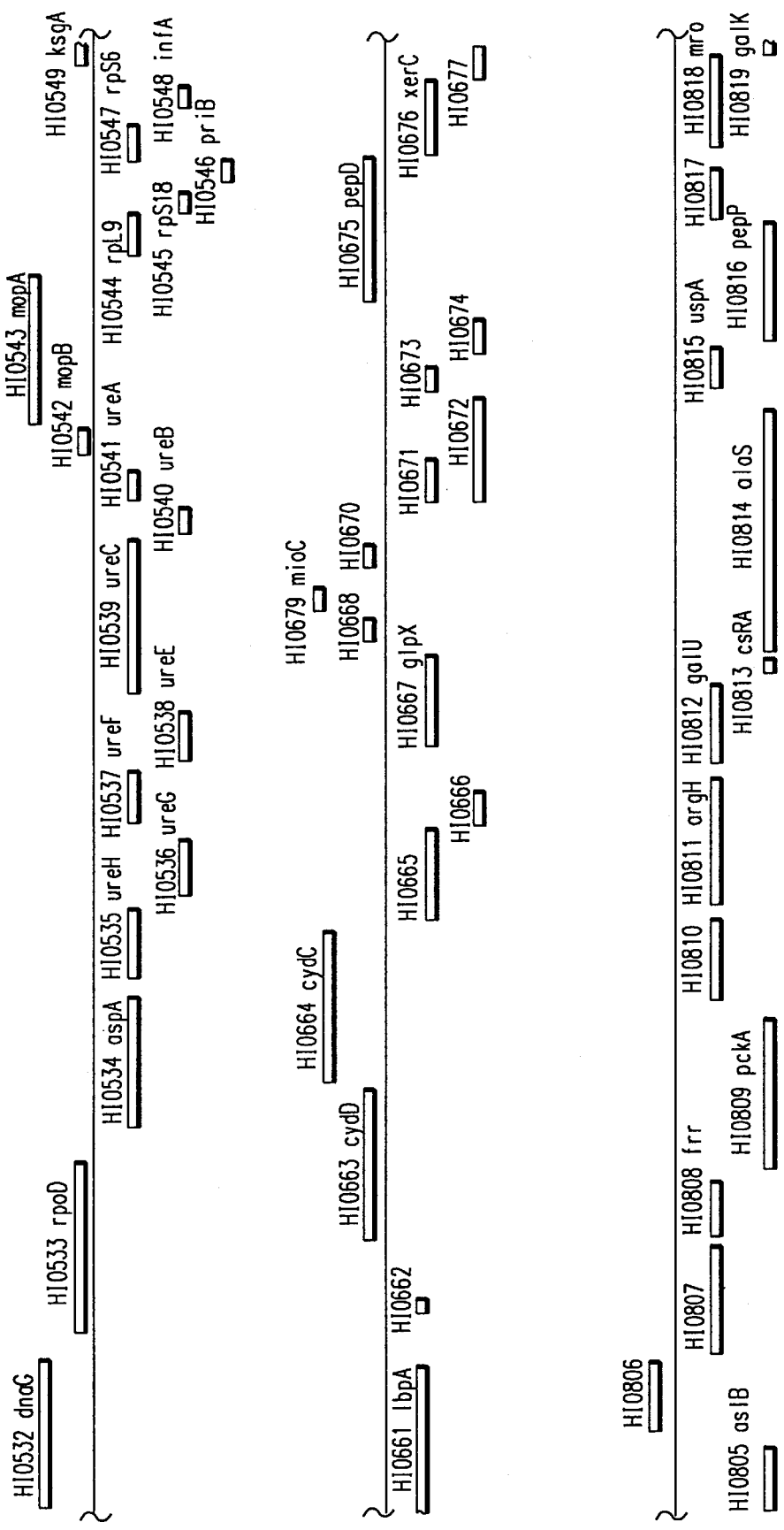
Figure 6S:
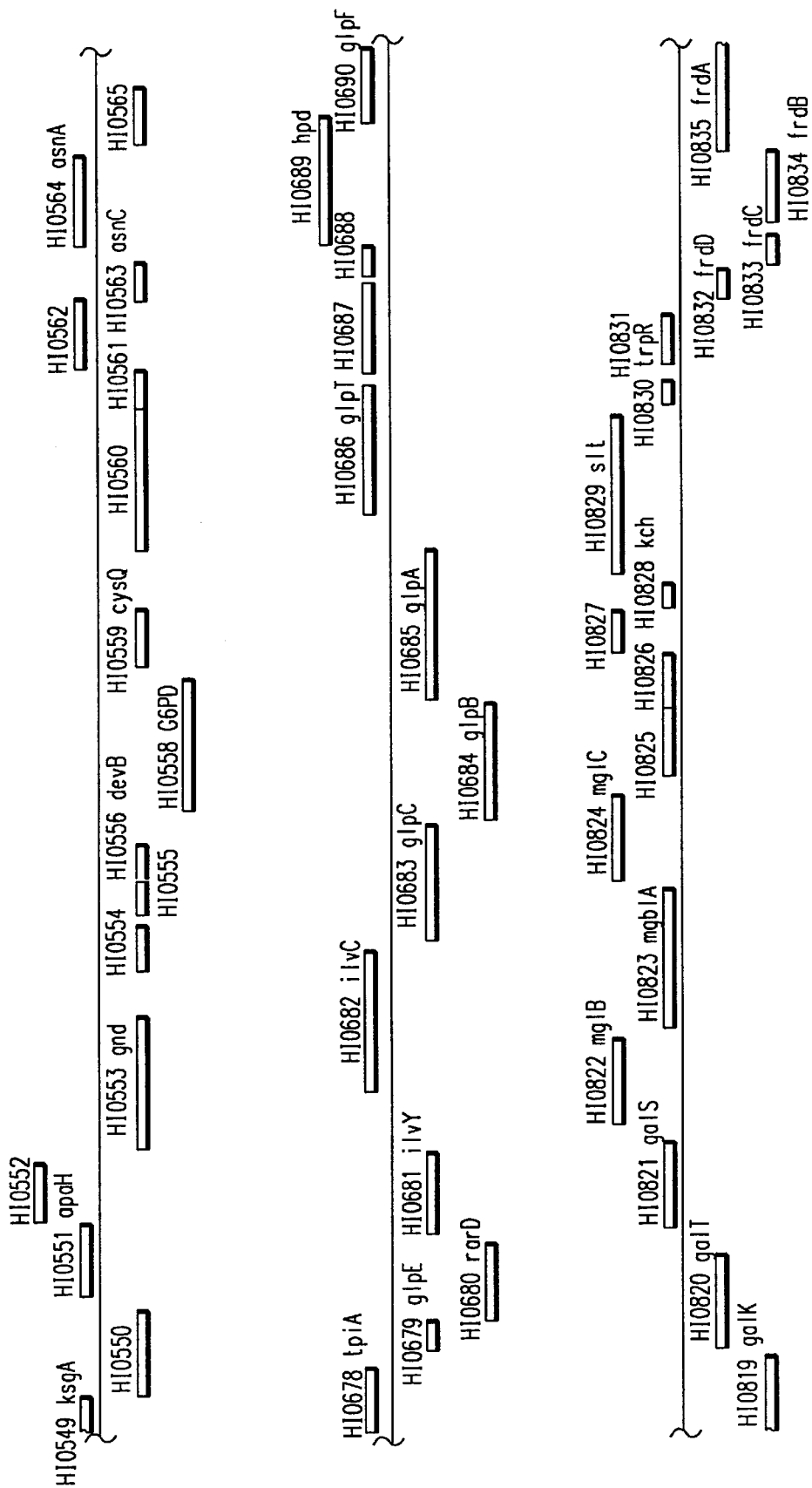
Figure 6T:
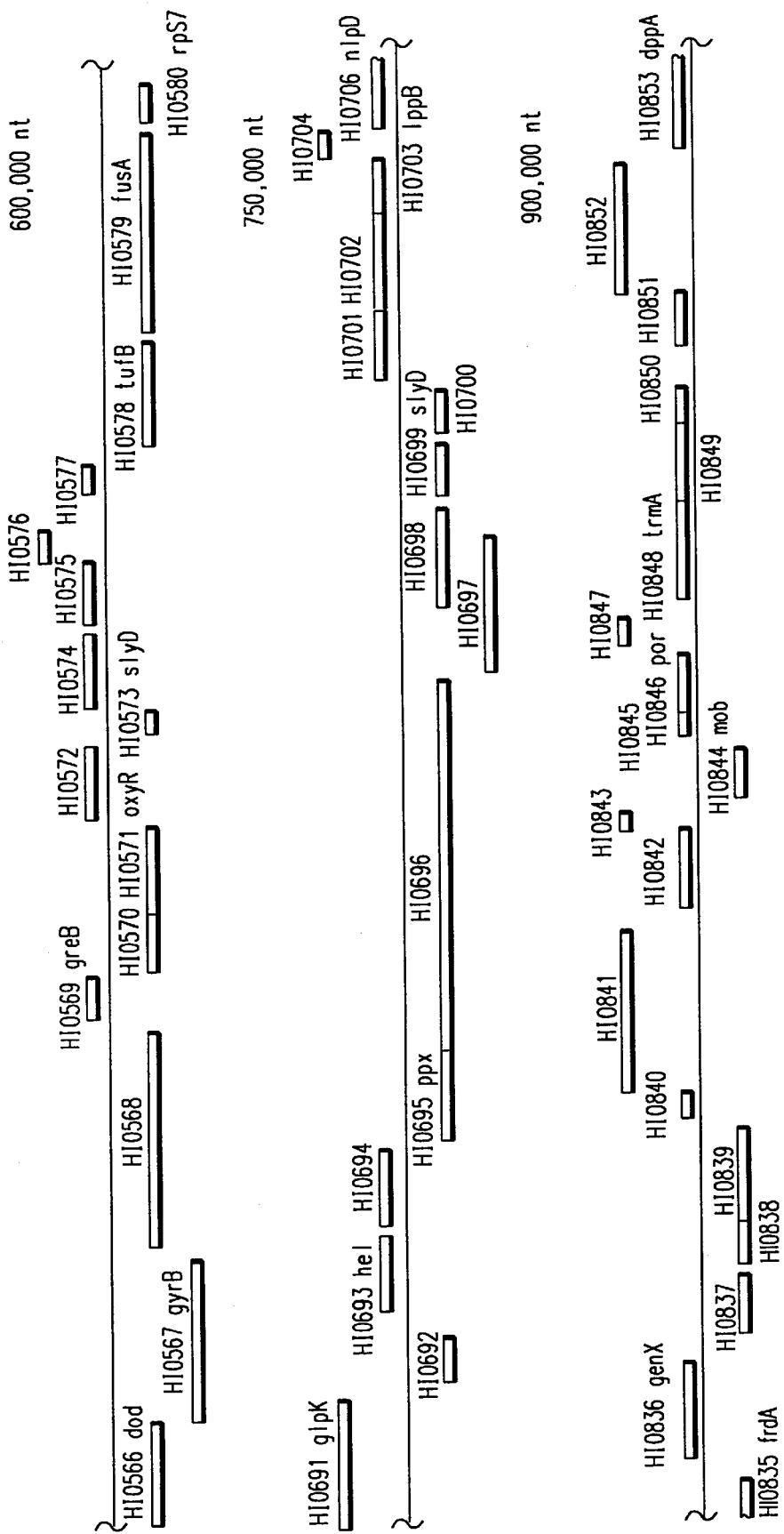
Figure 6U:
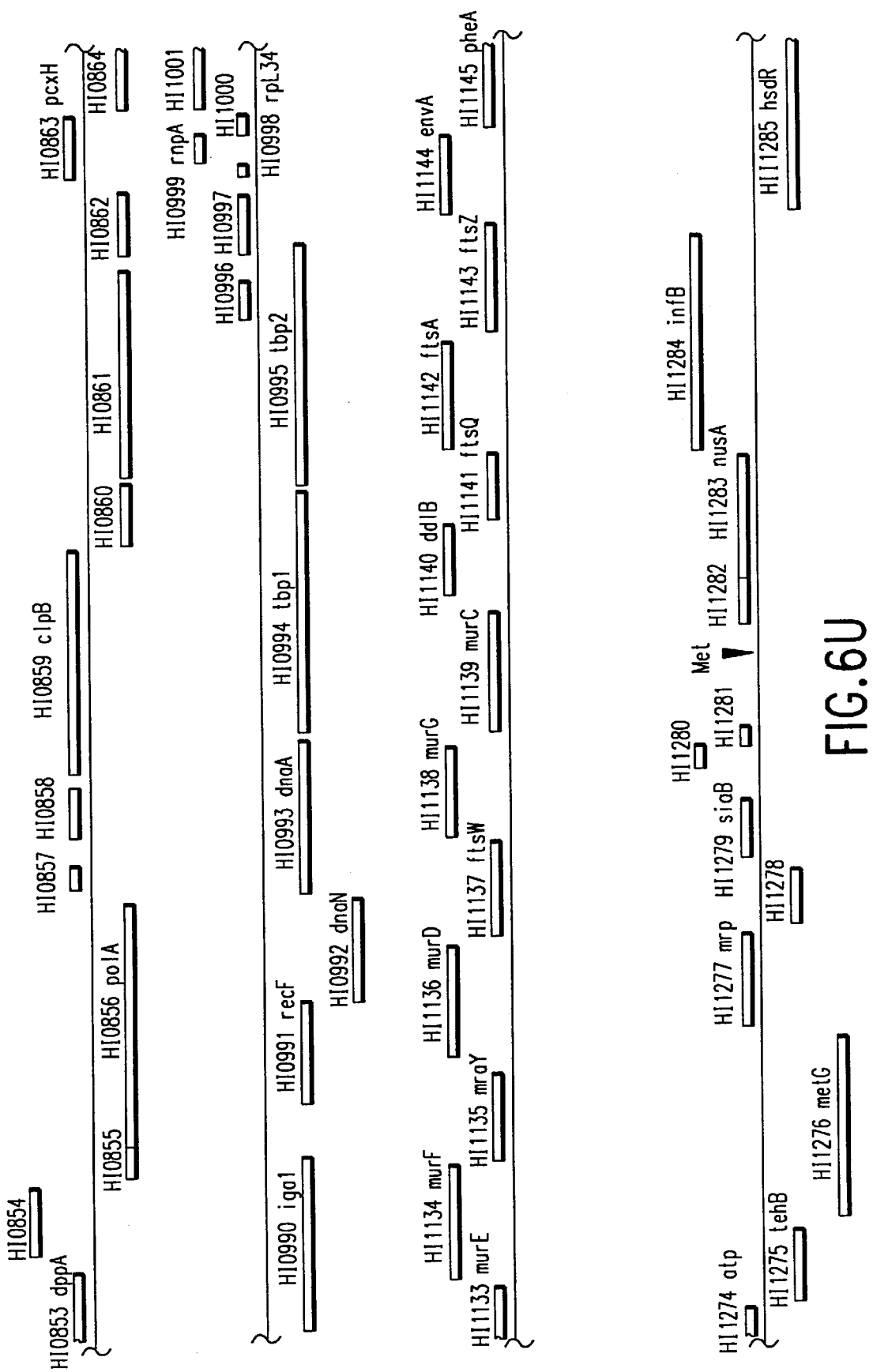
Figure 6V:
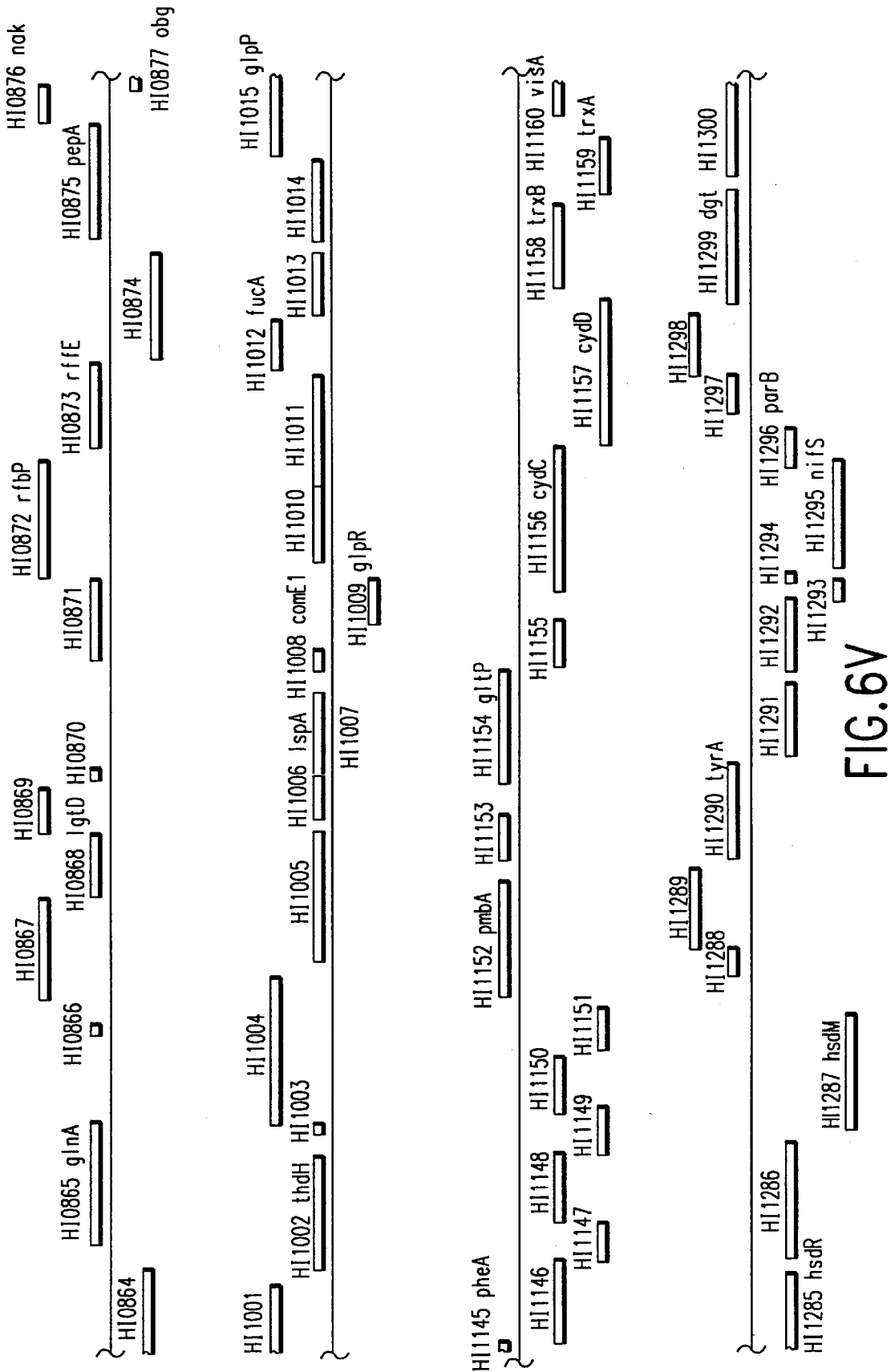
Figure 6W:
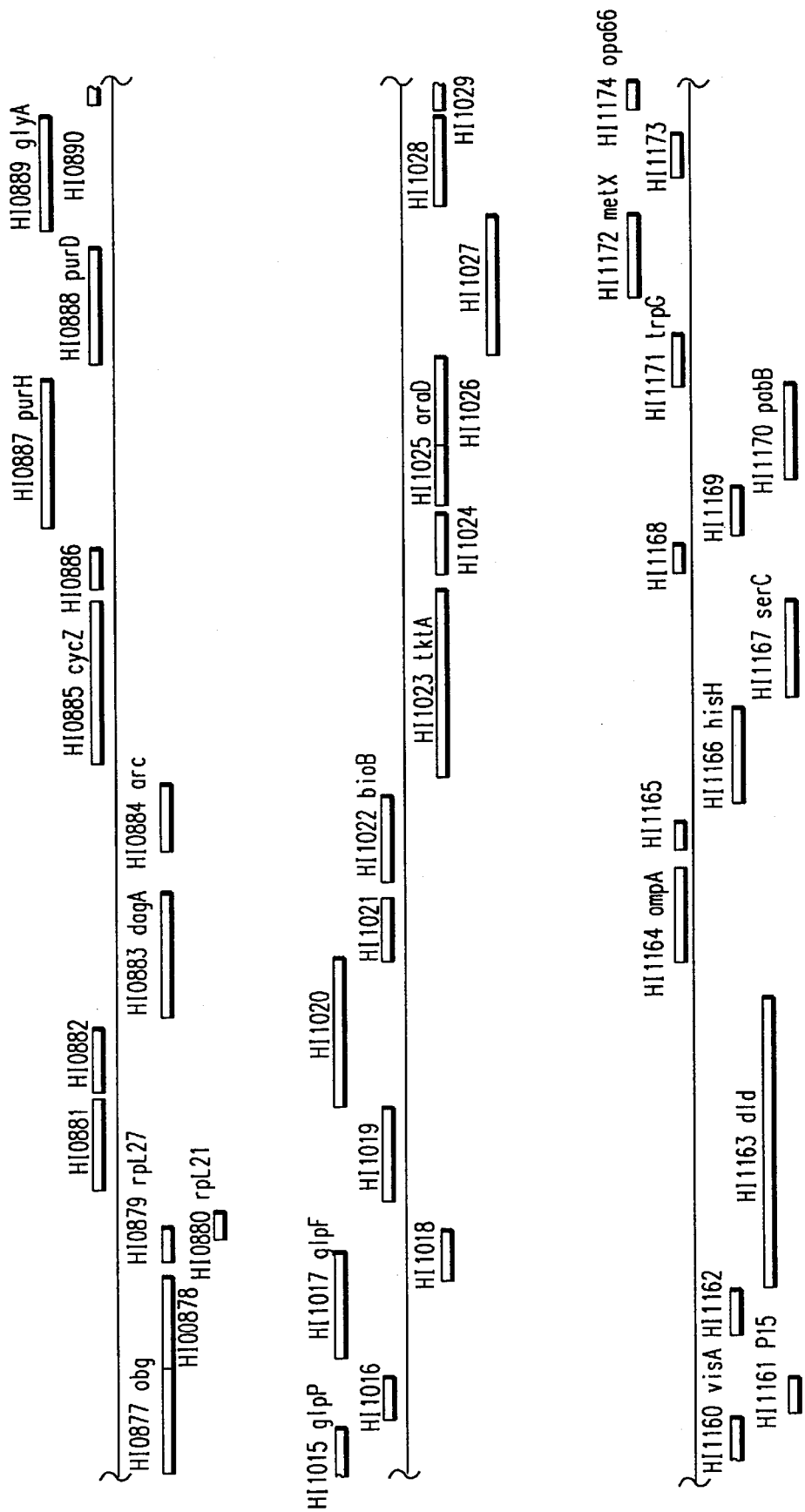
Figure 6X:
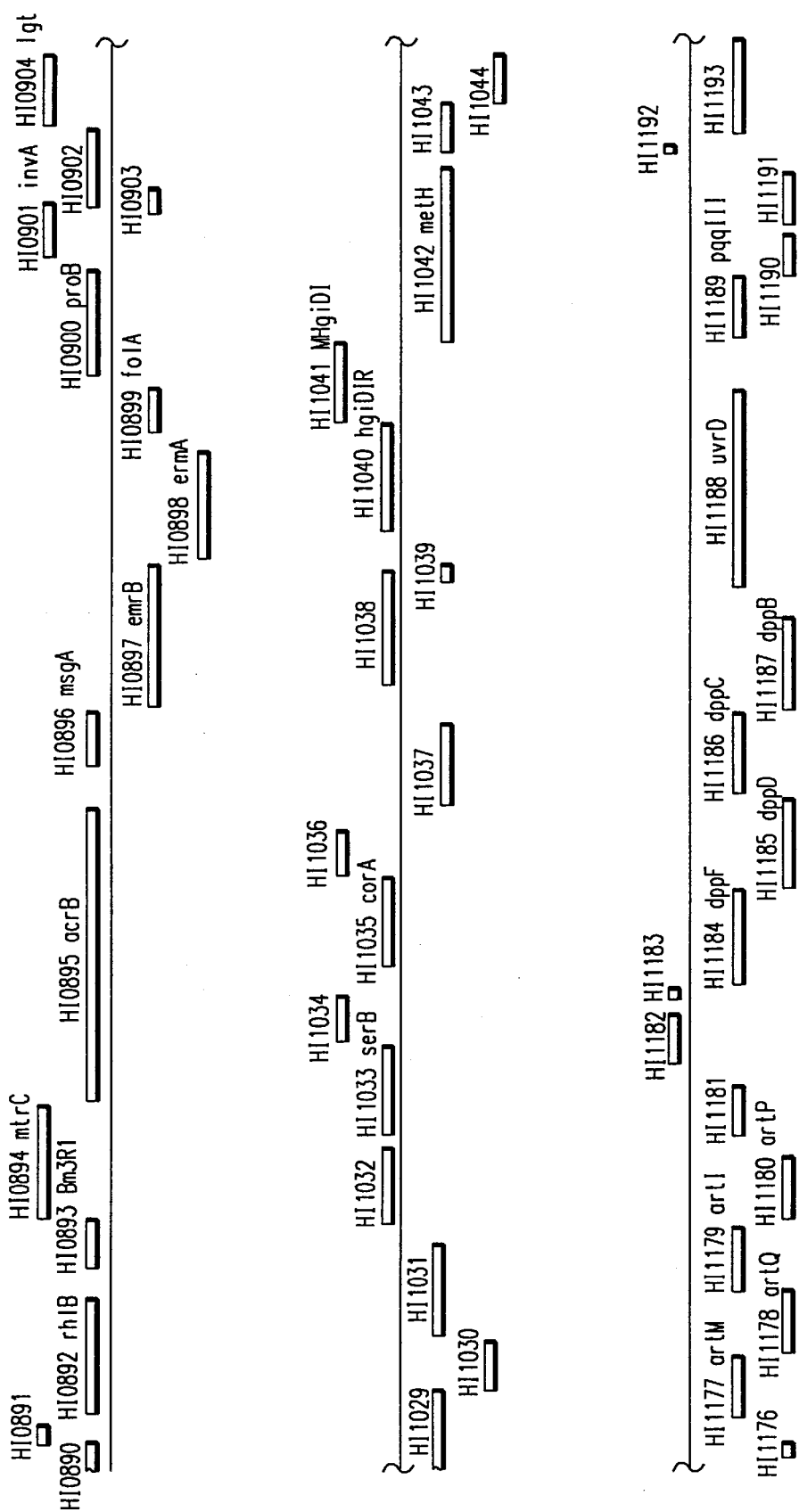
Figure 6Y:
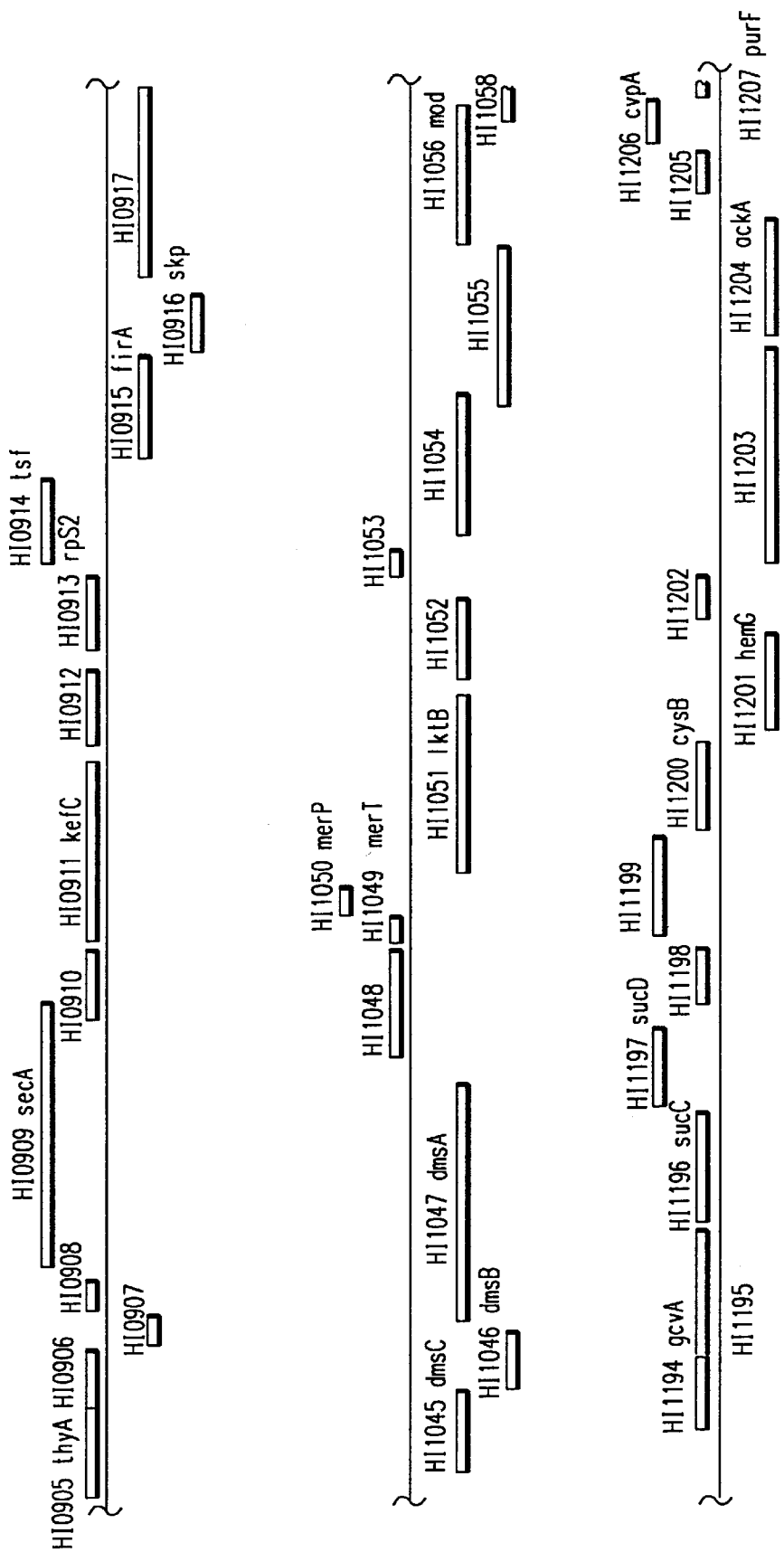
Figure 6Z:
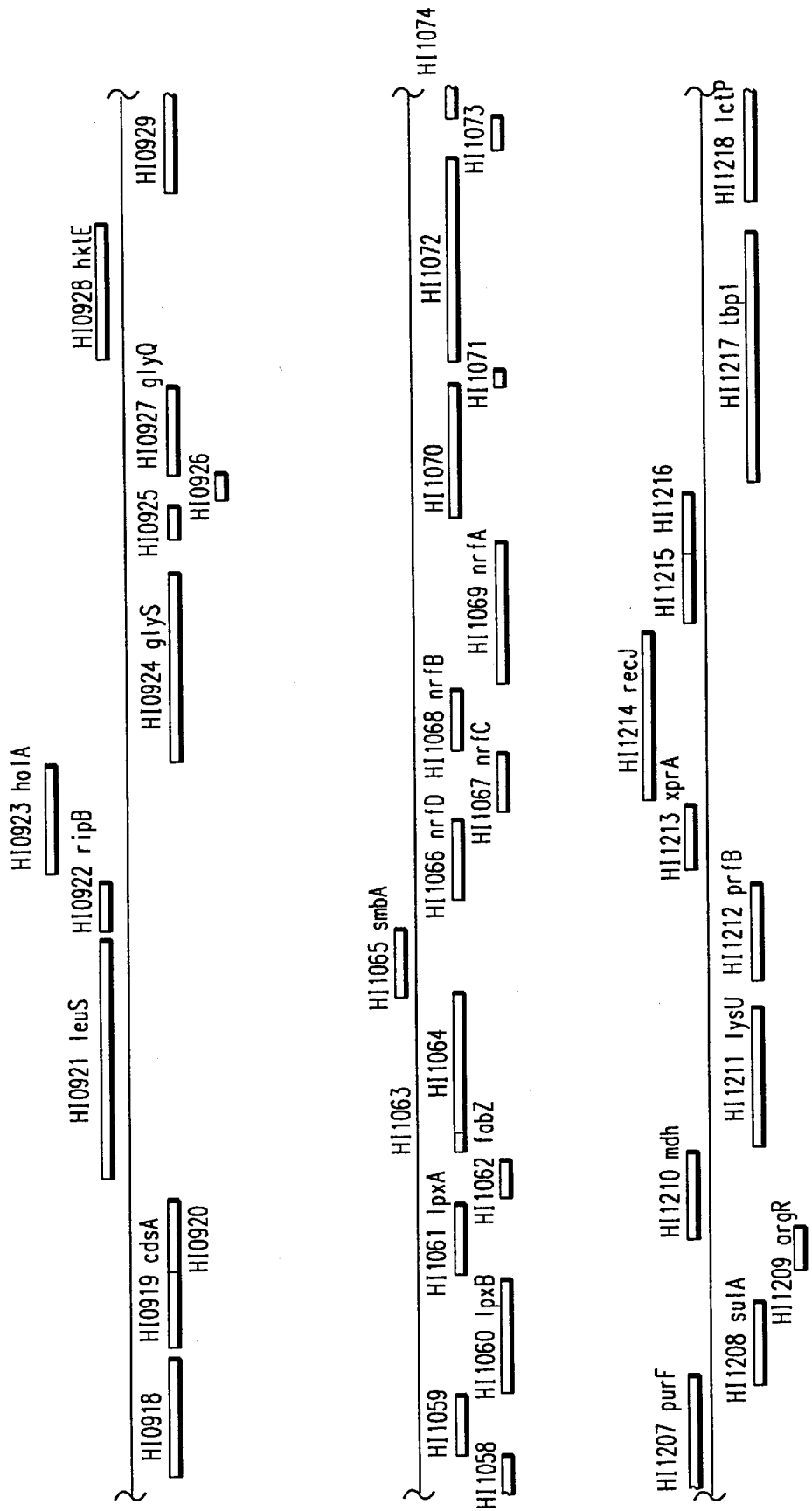
Figure 6A:
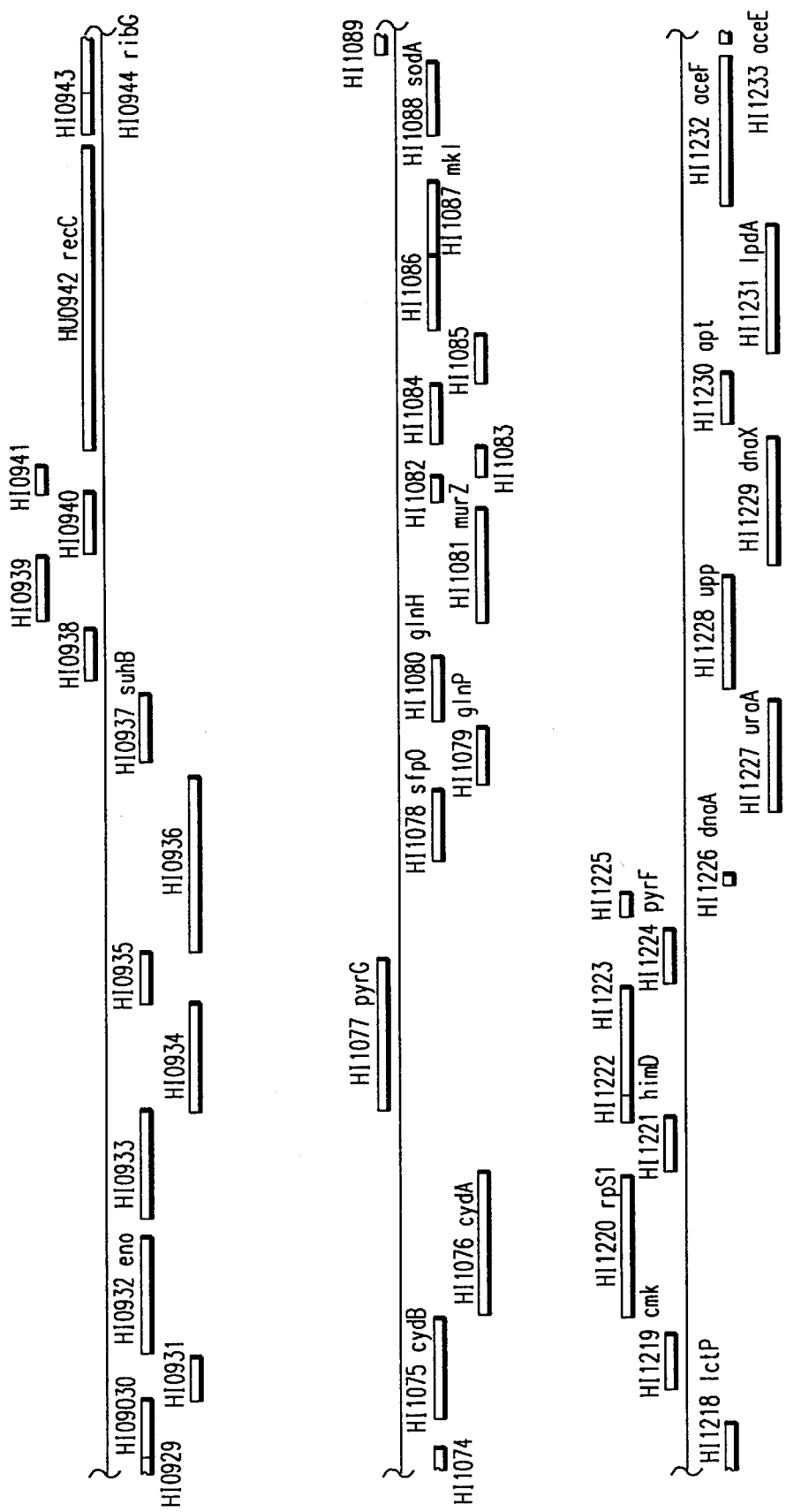
Figure 6A:
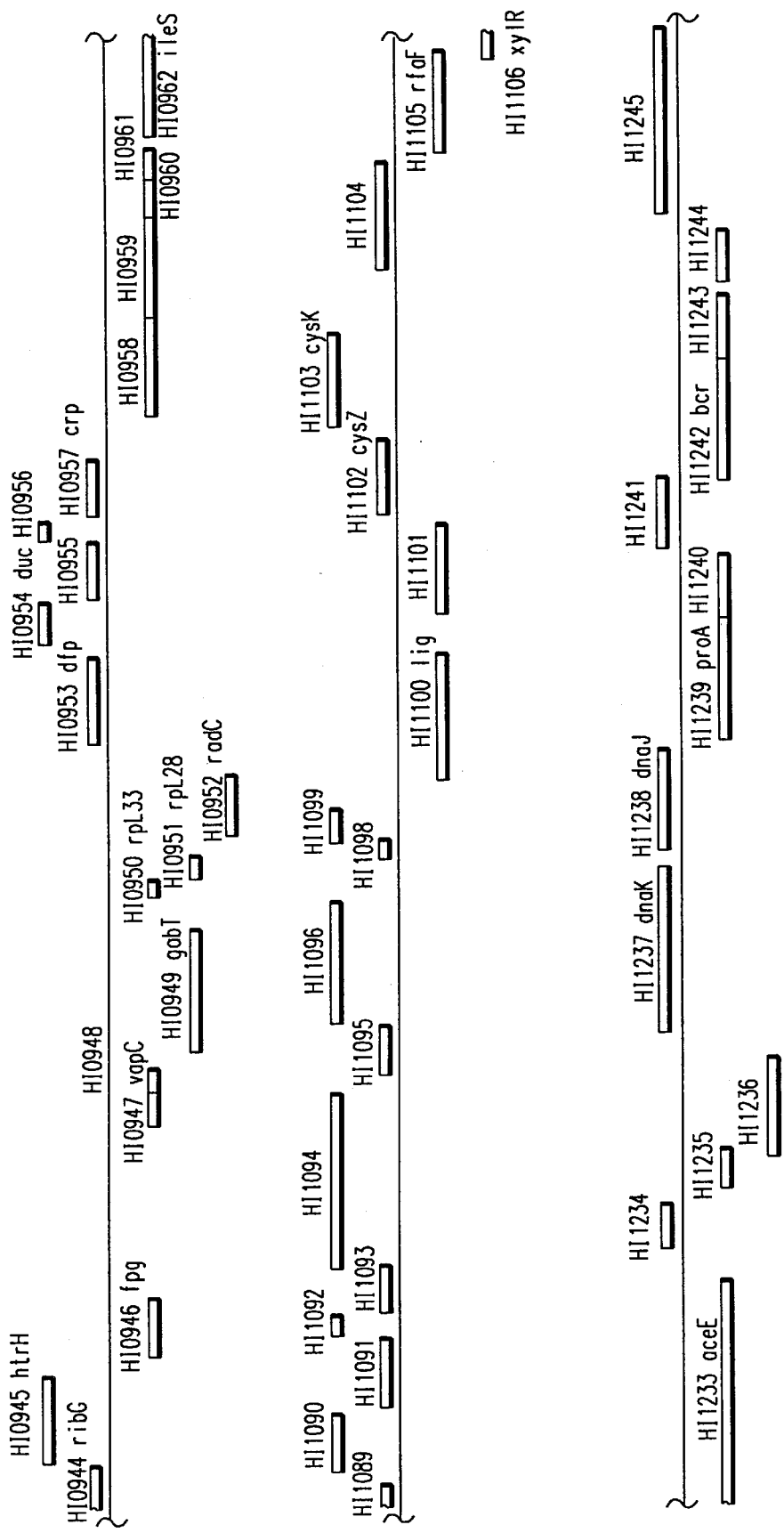
Figure 6A:
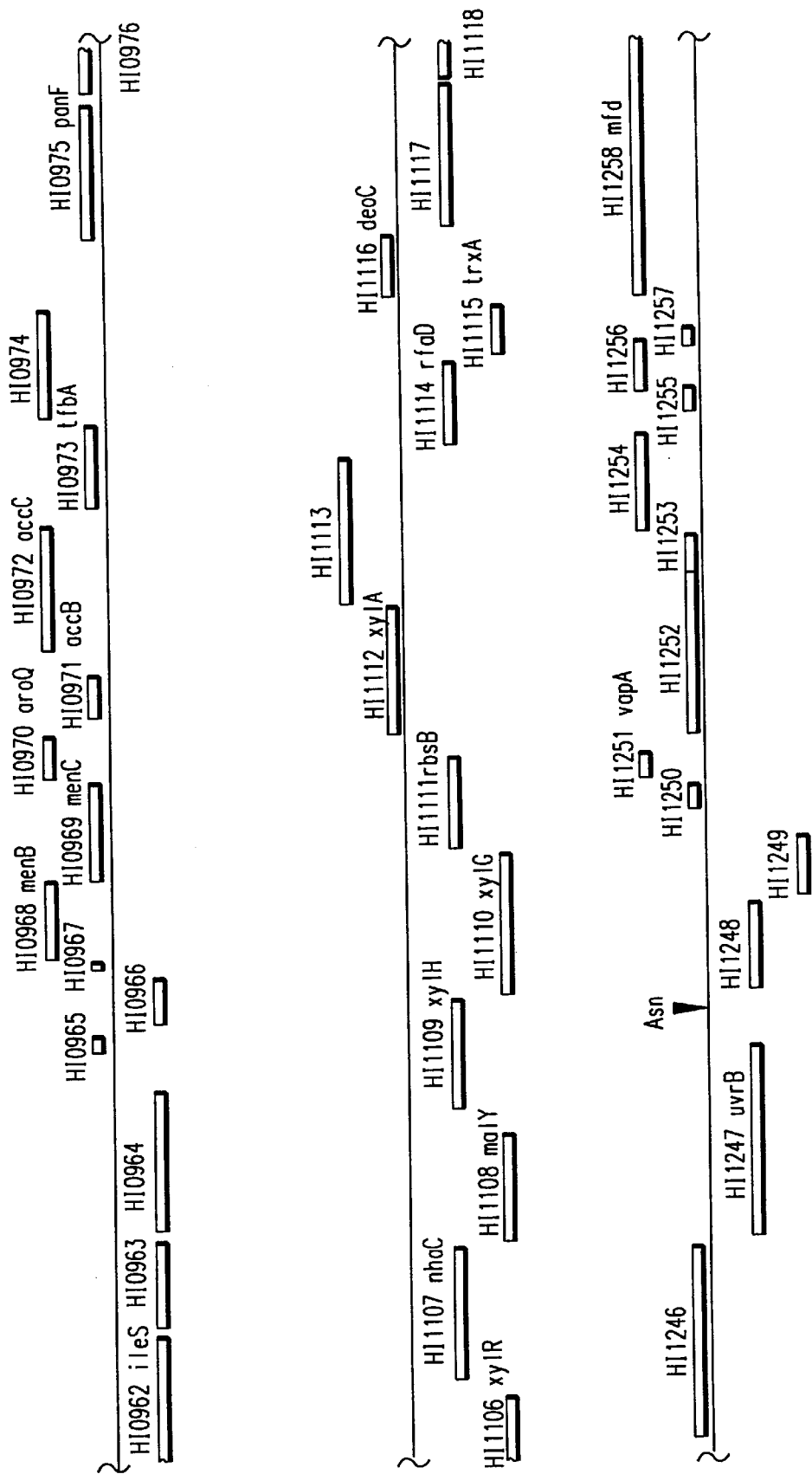
Figure 6A:
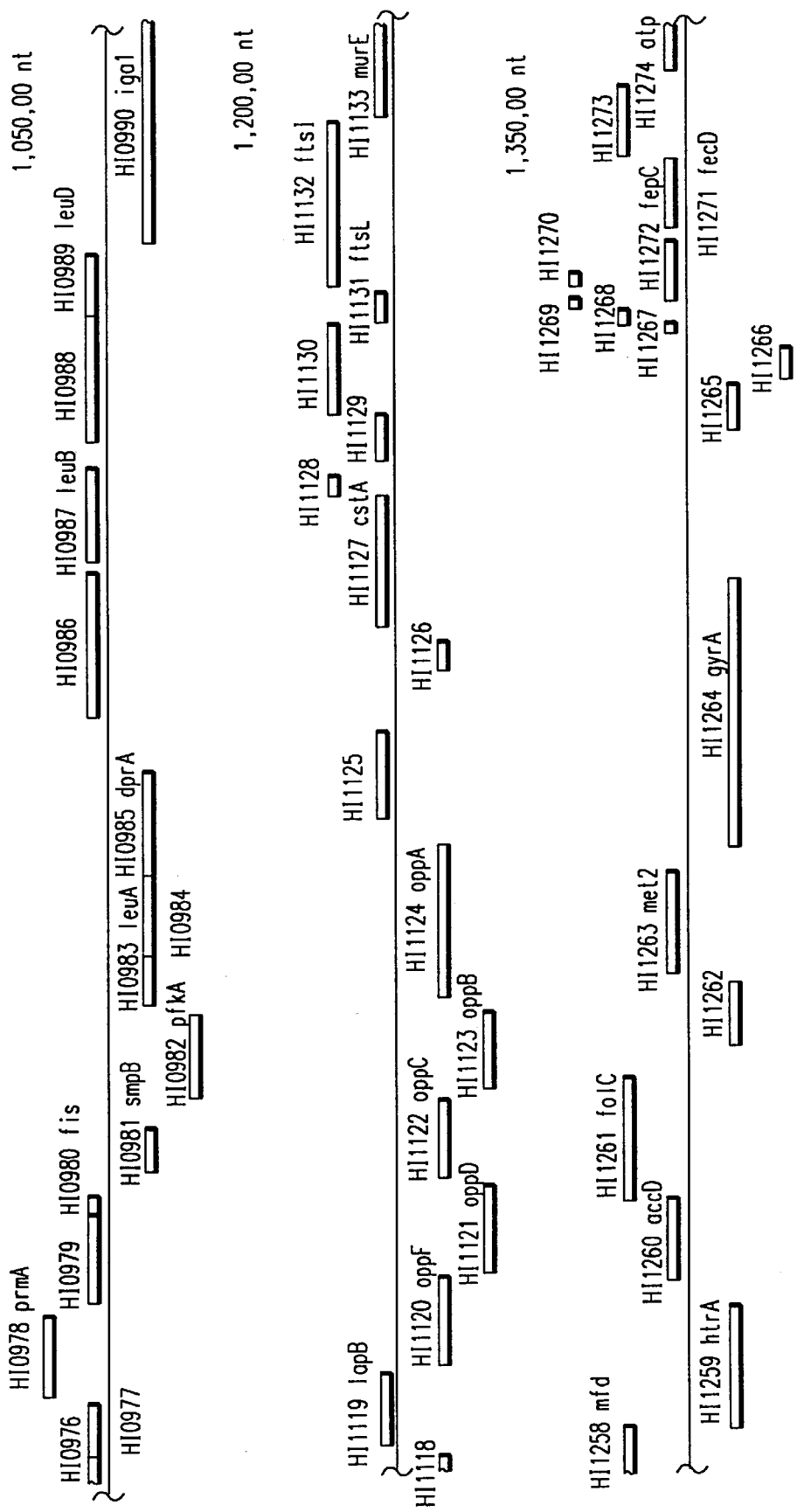
Figure 6A:
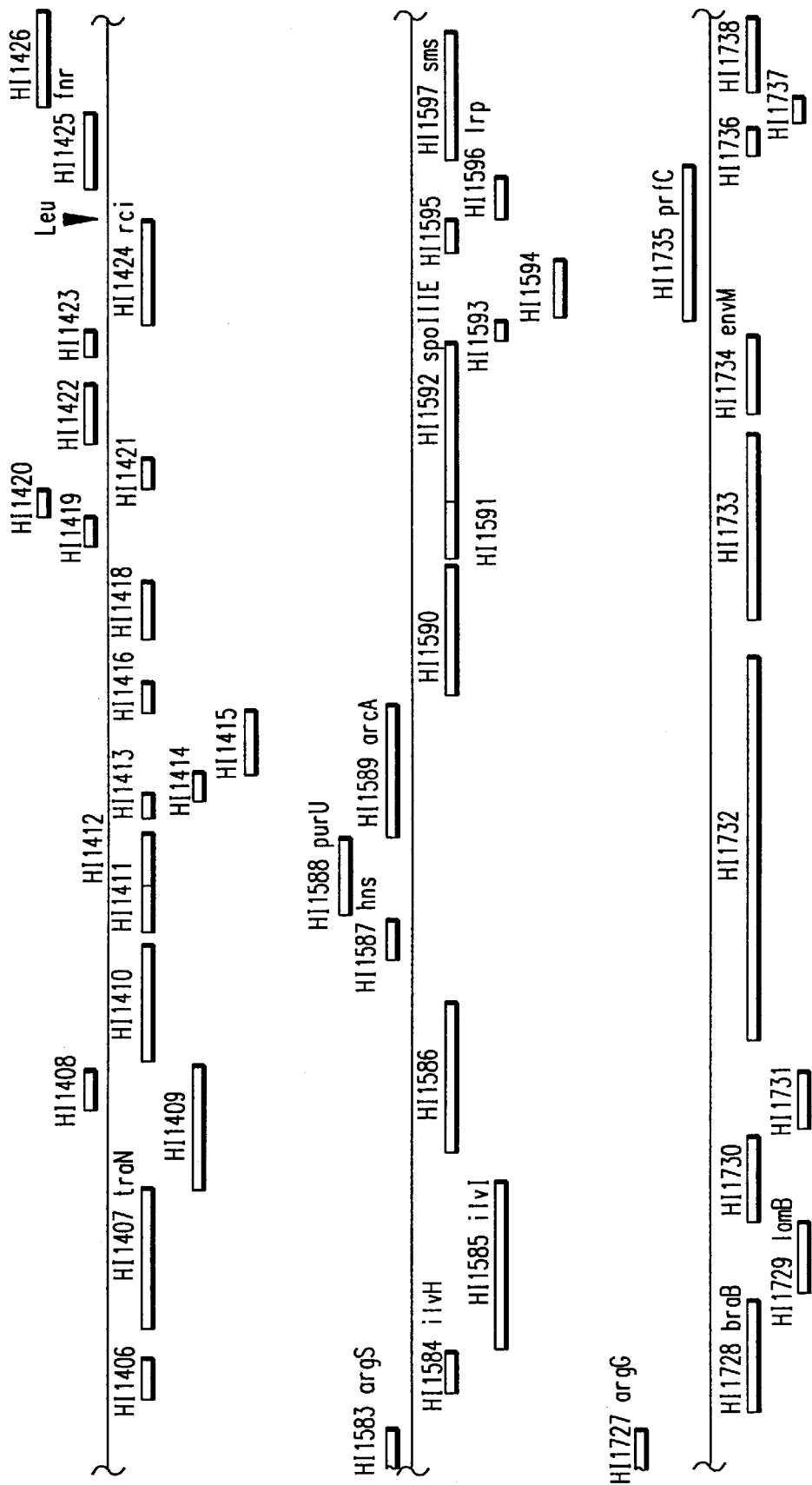
Figure 6A:
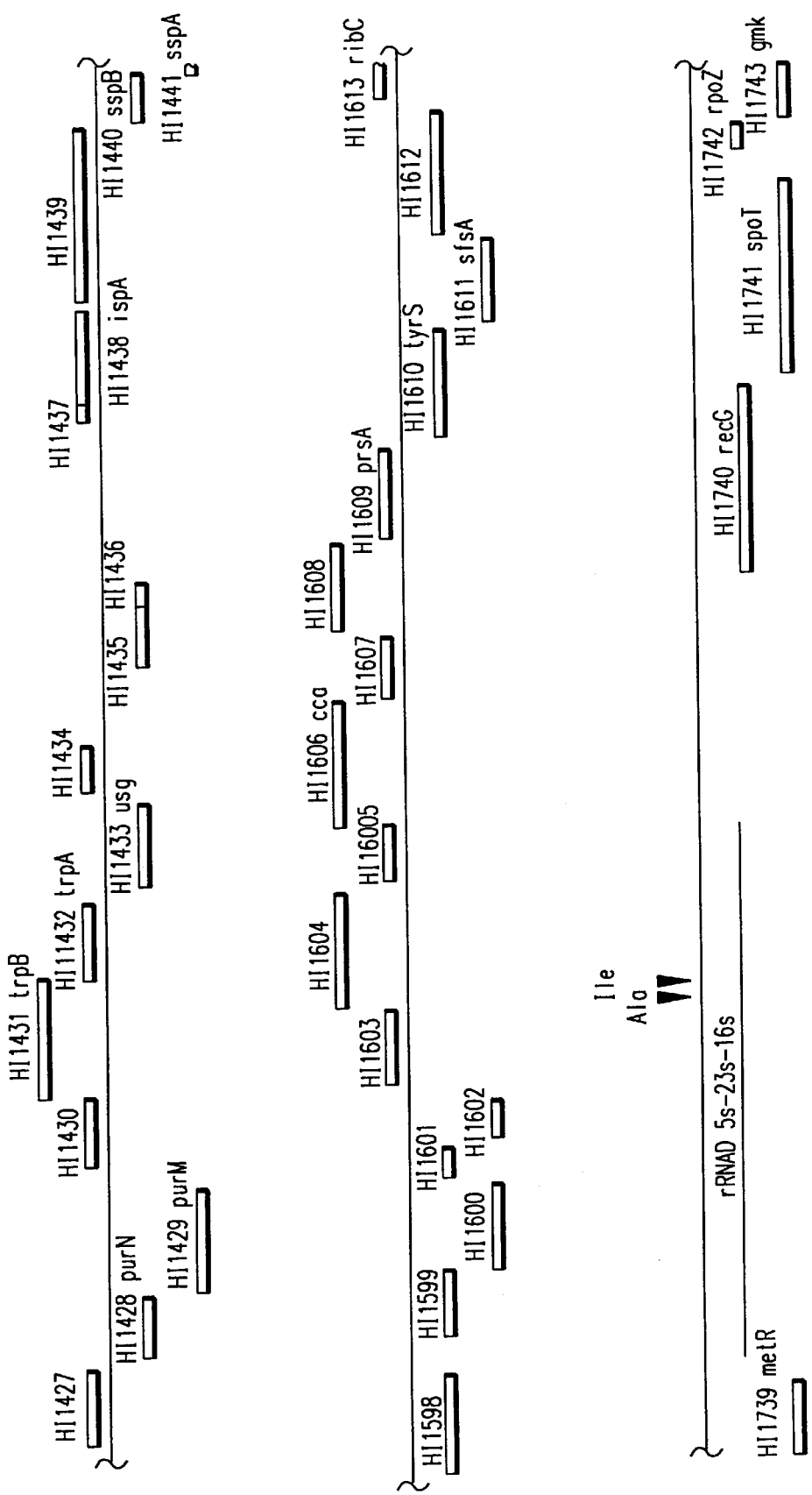
Figure 6A:
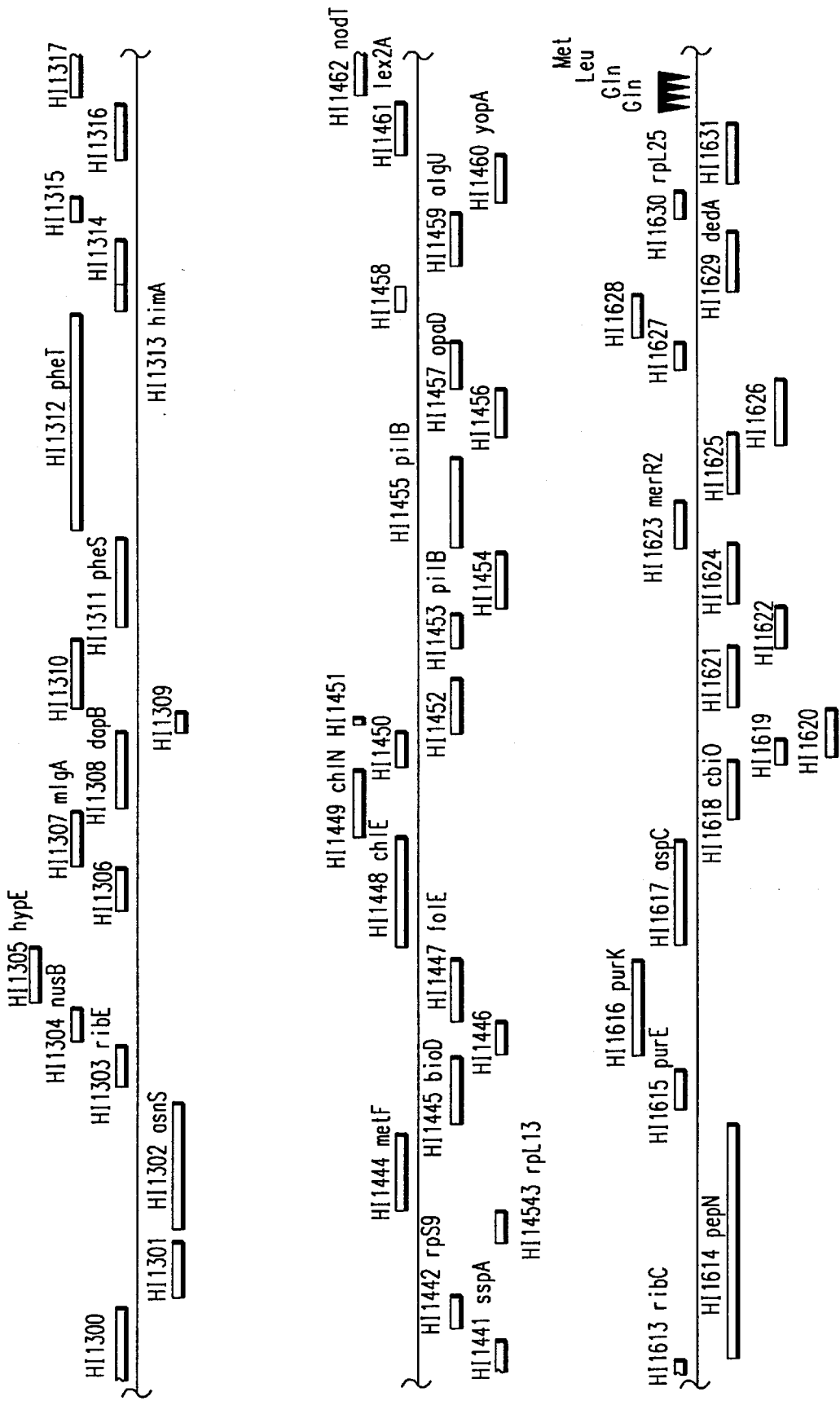
Figure 6A:
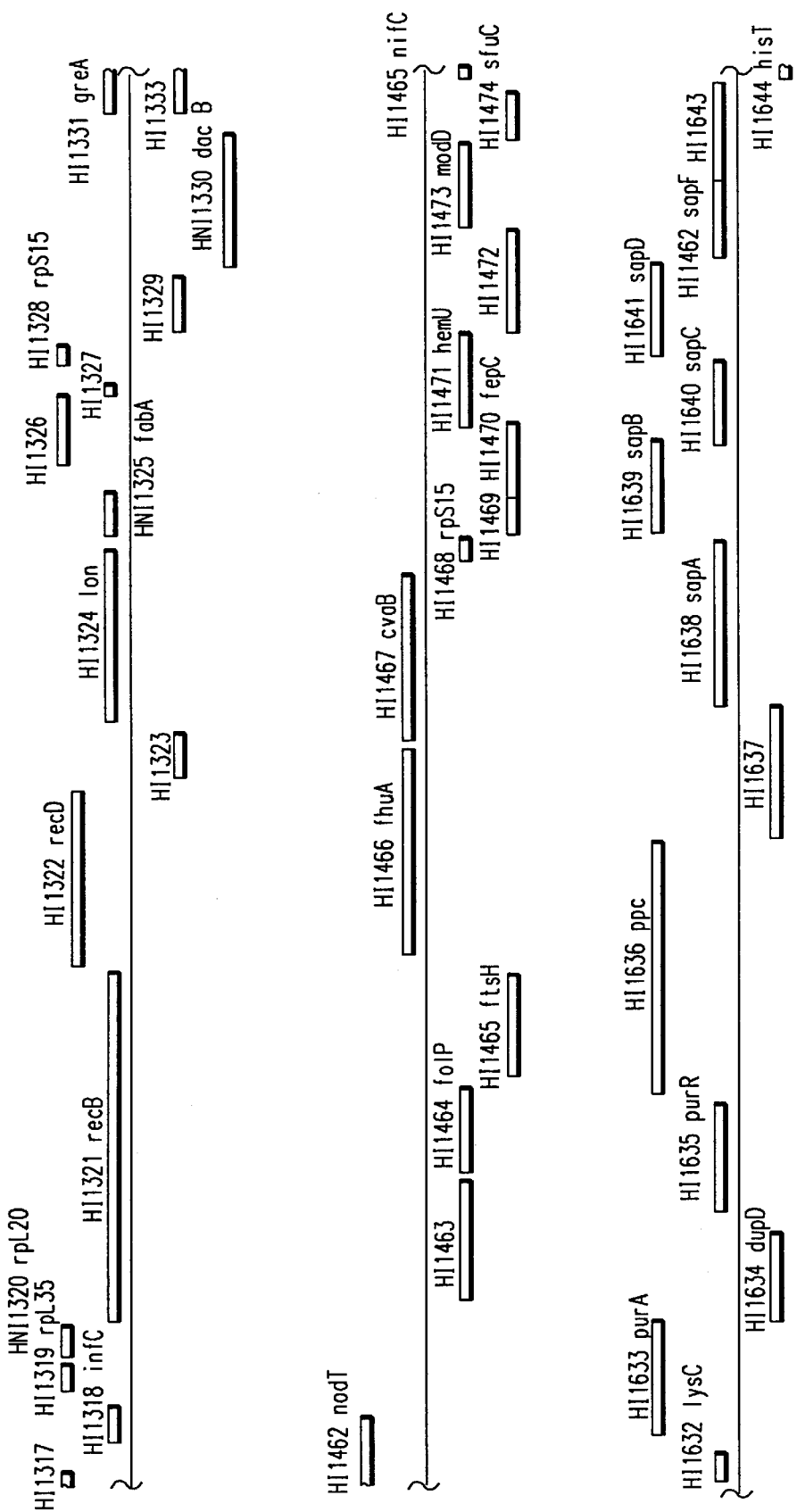
Figure 6A:
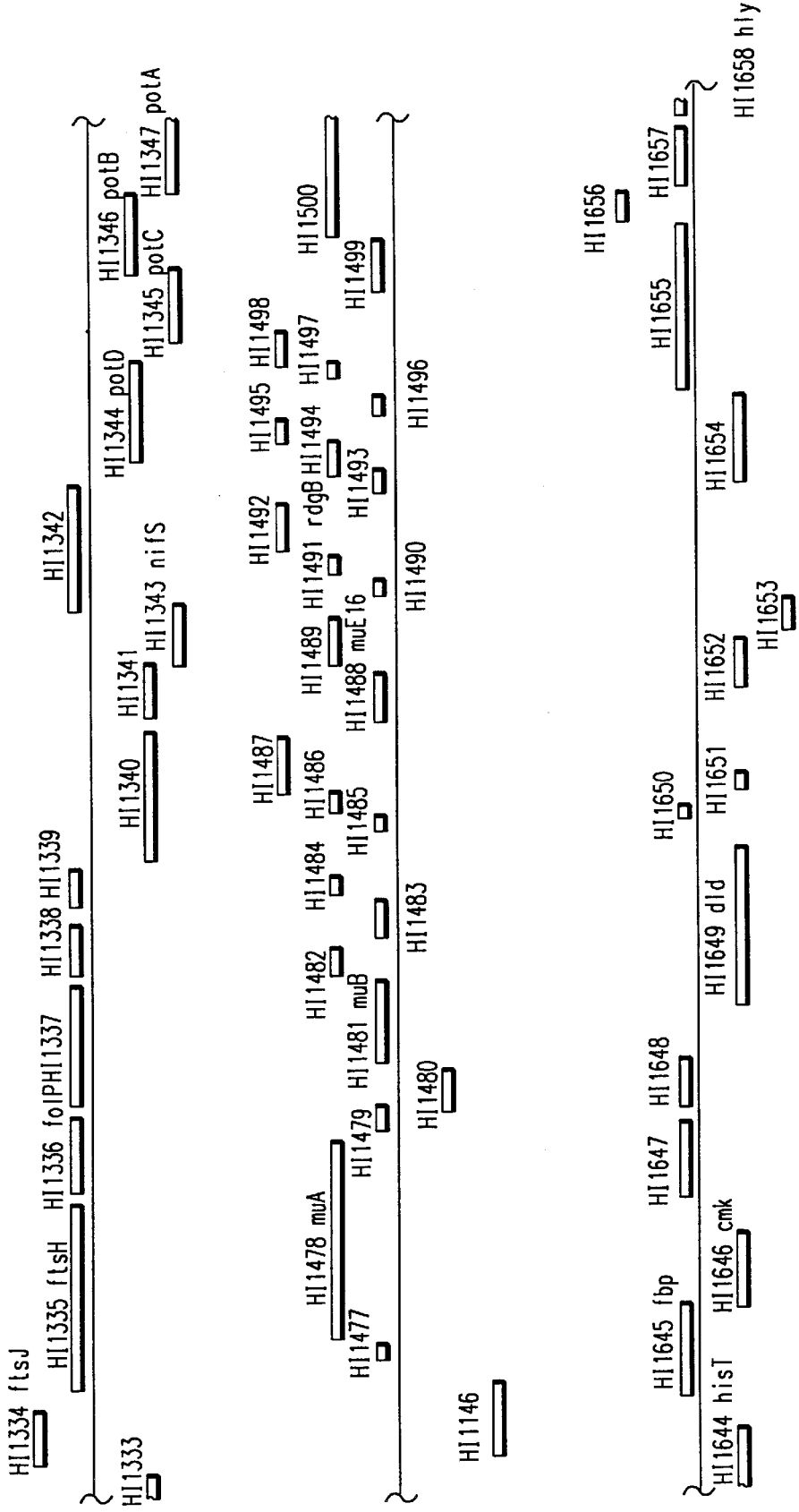
Figure 6A:
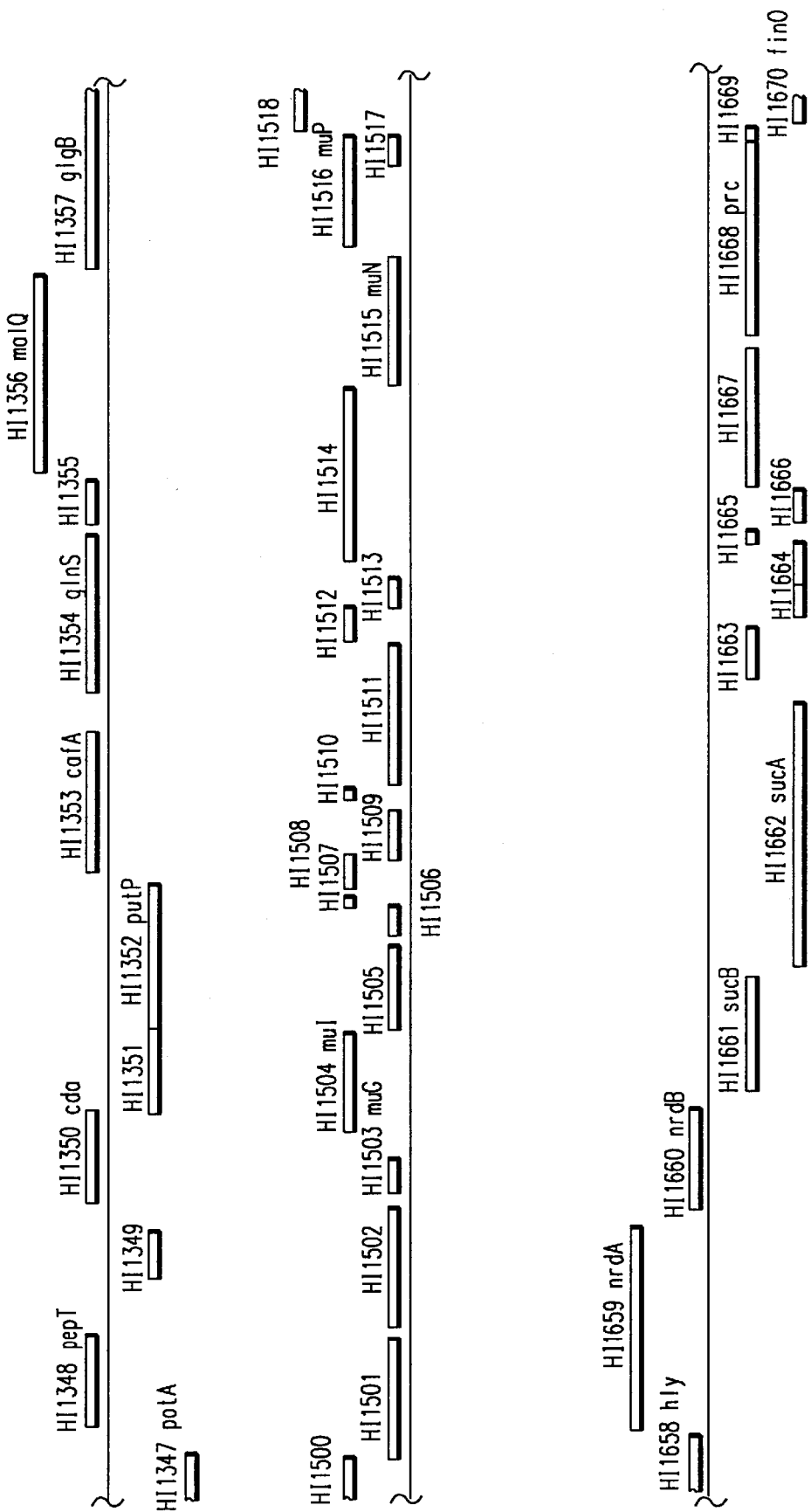
Figure 6A:
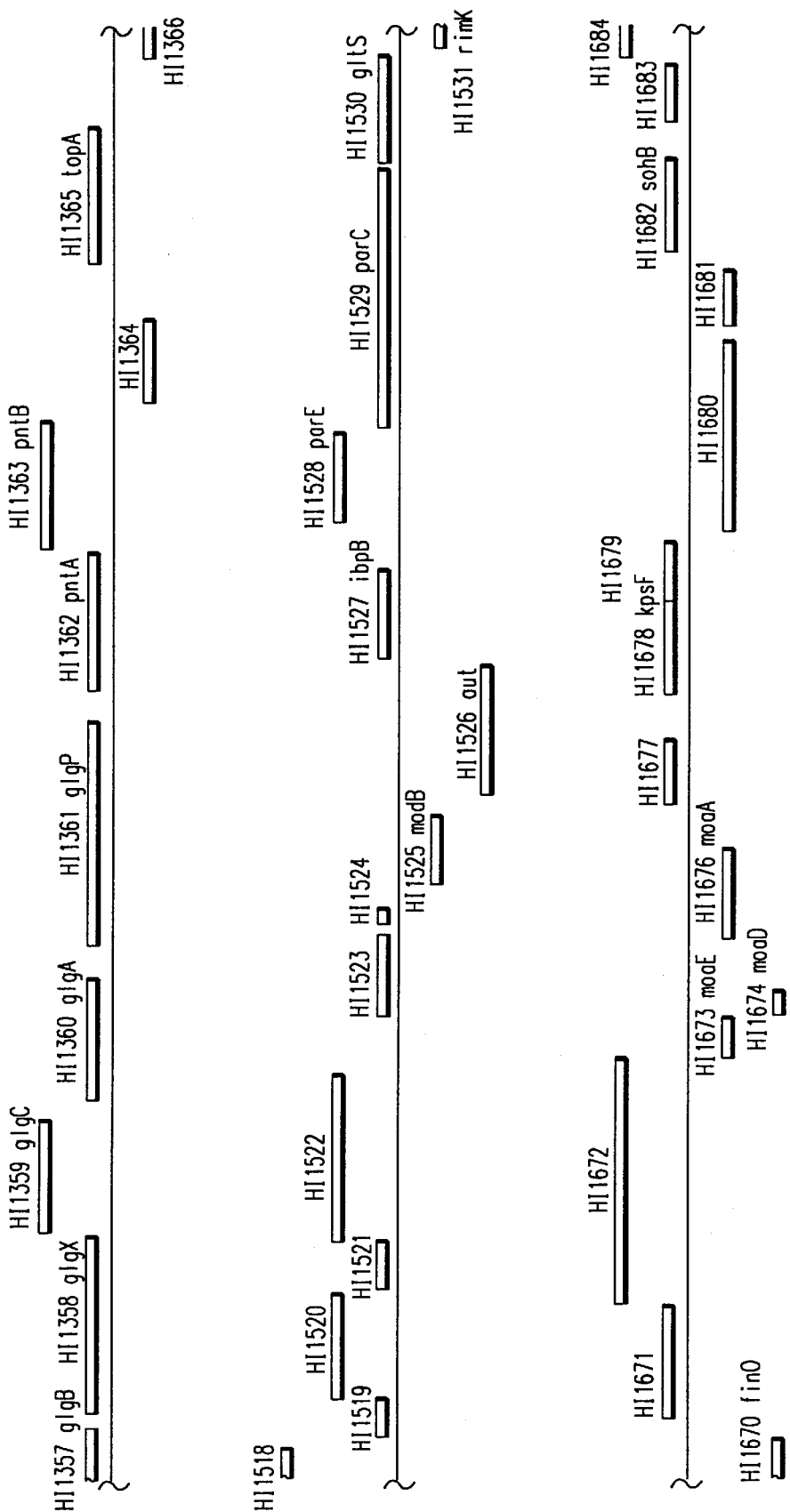
Figure 6A:
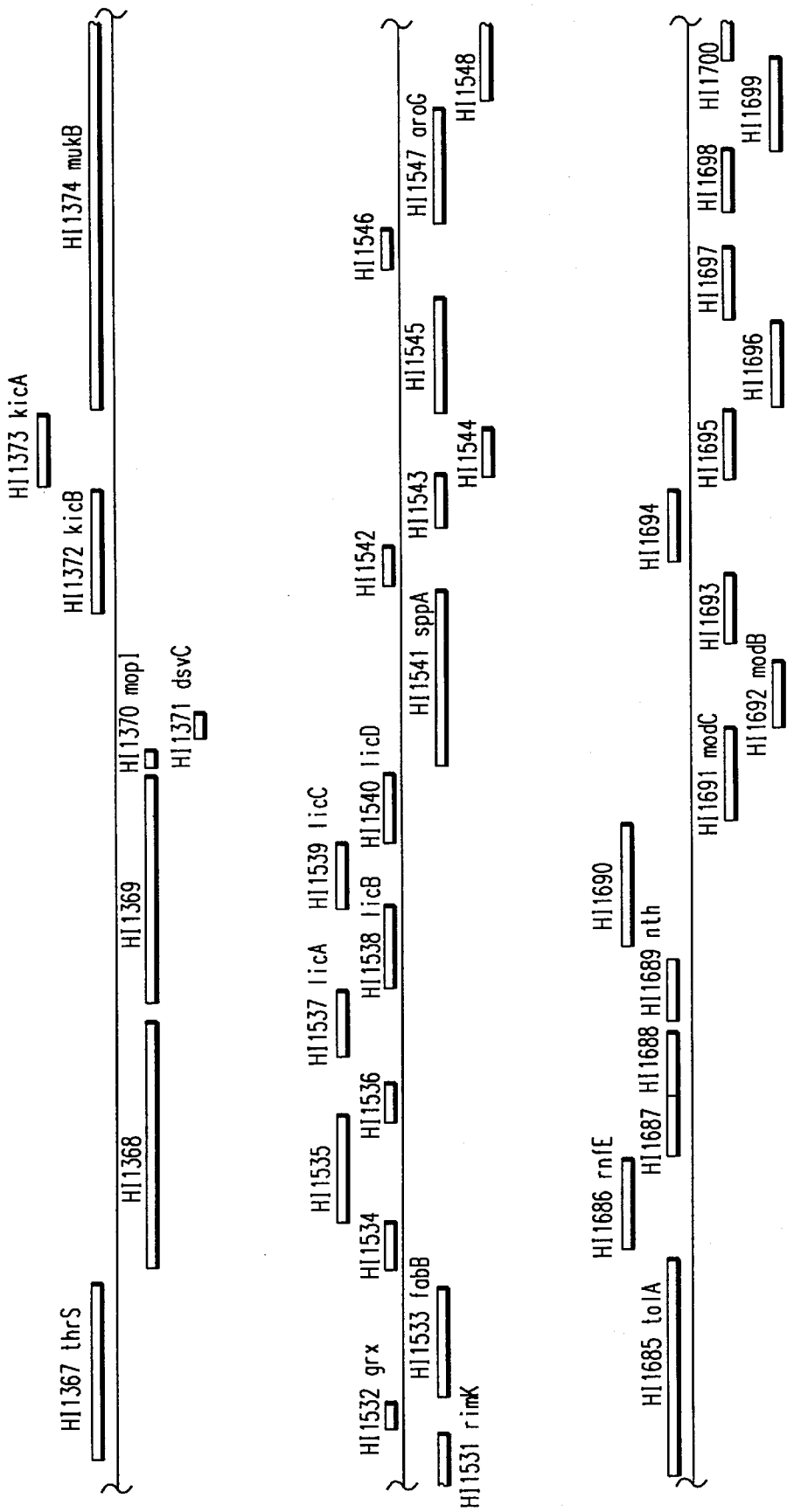
Figure 6A:
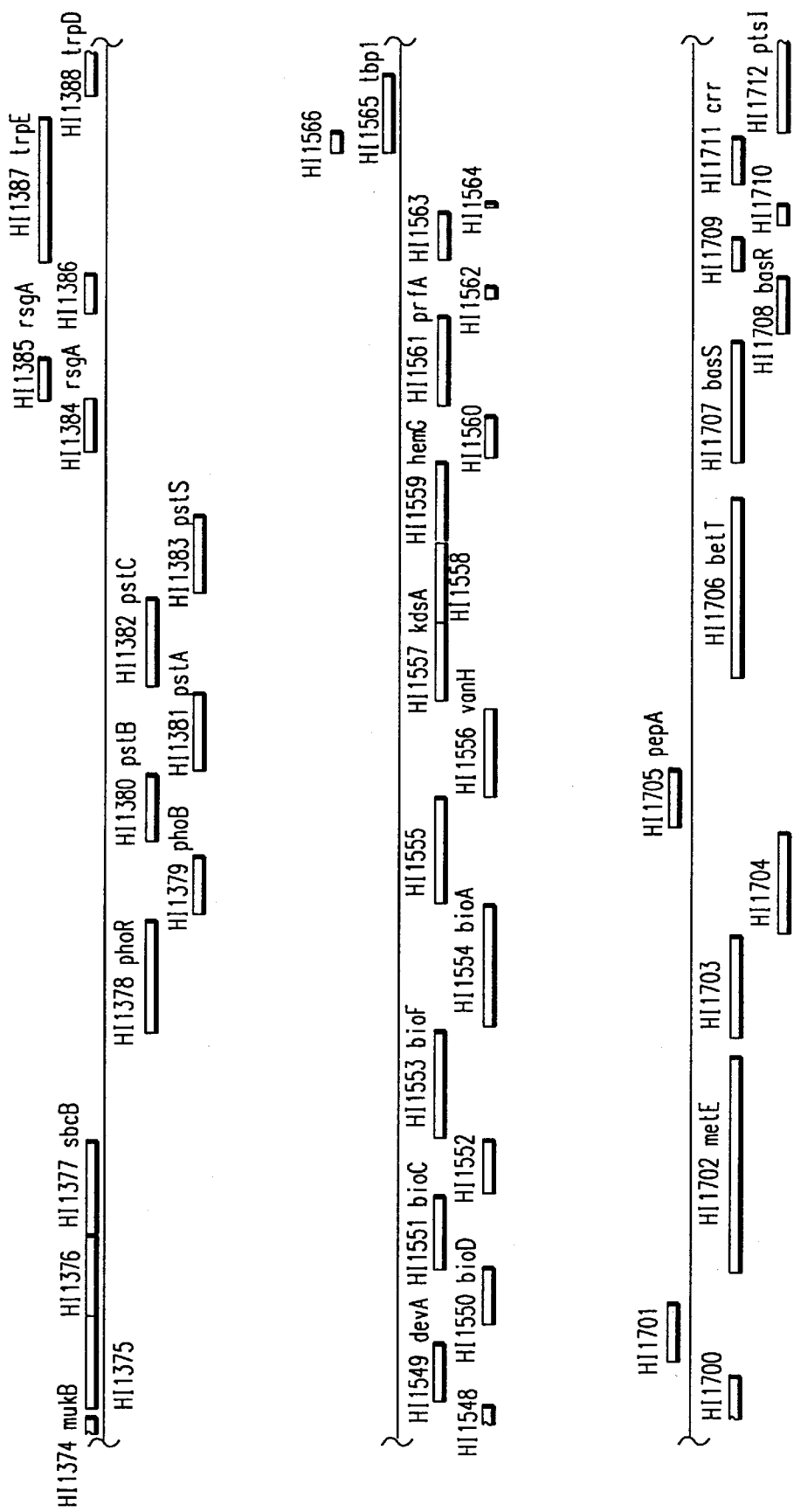
Figure 6A:

An annotated complete genome map of *H. influenaze* Rd is presented in FIGS. 6A–N. The map places each predicted coding region on the *H. influenaze* chromosome, indicates its direction of transcription and color codes its role assignment. Role assignments are also represented in FIG. 5.

A survey of the genes and their chromosomal organization in *H. influenaze* Rd make possible a description of the metabolic processes *H. influenaze* requires for survival as a free living organism, the nutritional requirements for its growth in the laboratory, and the characteristics which make it unique from other organisms specifically as it relates to its pathogenicity and virulence. The genome would be expected to have complete complements of certain classes of genes known to be essential for life. For example, there is a one-to-one correspondence of published *E. coli* ribosomal protein sequences to potential homologs in the *H. influenaze* database. Likewise, as shown in Table 1(a), an aminoacyl tRNA-synthetase is present in the genome for each amino acid. Finally, the location of tRNA genes was mapped onto the genome. There are 54 identified tRNA genes, including representatives of all 20 amino acids.

In order to survive as a free living organism, *H. influenaze* must produce energy in the form of ATP via fermentation and/or electron transport. As a facultative annerobe, *H. influenaze* Rd is known to ferment glucose, fructose, galactose, ribose, xylose and fucos. (Dorocicz et. al., *J. Bacteriol.* 175:7142 (1993)). The genes identified in Table 1(a) indicate that transport systems are available for the uptake of these sugars via the phosphoenolpyruvate-phosphotransferase system (PTS), and via non-TPS mechanisms. Genes that specify the common phosphate-carriers Enzyme I and Hpr (ptsI and ptsH) of the PTS system were identified as well as the glucose specific crr gene. The ptsH, ptsI, and crr genes constitute the pts operon. We have not however identified the gene encoding membrane-bound glucose specific Enzyme II. The latter enzyme is required for transport of glucose by the PTS system. A complete PTS system for fructose was identified.

Genes encoding the complete glycolytic pathway for the production of fermentative end products were identified. Growth utilizing anserobic respiratory mechanisms were found by identifying genes encoding functional electron transport systems using inorganic electron acceptors such as nitrates, nitrites, and dimethylsulfoxide. Genes encoding three enzymes of the tricarboxylic acid (TCA) cycle appear to be absent from the genome. Citrate synthase, isocitrate dehydrogenase, and acordtase were not found by searching the predicted coding regions or by using the *E. coli* enzymes as peptide queries against the entire genome in translation. This provides an explanation for the very high level of glutamate (Ig/L) which is required in defined culture media (Klein and Luginbuhi, *J. Gen. Microbiol.* 113:409 (1979)). Glutamate can be directed into the TCA cycle via conversion to alpha-ketoglutarate by glutamate dehydrogenase. In the absence of a complete TCA cycle, glutamate presumably serves as the source of carbon for biosynthesis of amino acids using precursors, which branch from the TCA cycle. Functional electron transport systems are available for the production of ATP cycle. Functional electron transport systems are available for the production of ATP using oxygen as a terminal electron acceptor.

Previously unanswered questions regarding pathogenicity and virulence can be addressed by examining certain classes of genes such as adhesions and the lipooligosaccharide biogenesis genes. Mozon and co-workers (Weiser et al., *Cell* 59:657 (1989)) have obtained evidence that a number of these virulence-related genes contain tandem tetramer repeats which undergo frequent addition and deletion of one or more repeat units during replication such that the reading frame of the gene is changed and its expression thereby altered. It is now possible, using the complete genome sequence, to locate all such tandem repeat tracts (FIG. 5) and to begin to determine their roles in phase variation of such potential virulence genes.

*H. influenzae* Rd possess a highly efficient natural DNA transformation system (Kahn and Smith, *J. Membrane Biol.* 138:155 (1984). A unique DNA uptake sequence site, 5'AAGTGCGGT, present in multiple copies in the genome, has been shown to be necessary for efficient DNA uptake. It is now possible to locate all of these sites and completely describe their distribution with respect to genic and intergenic regions. Fifteen genes involved in transformation have already been described and sequenced (Redfield, R., *J. Bacteriol.* 173:5612 (1991); Chandler, M., *Proc. Natl. Acad. Sci. U.S.A.* 89:1616 (1992); Barouki and Smith, *J. Bacteriol.* 163(2):629 (1985); Tomb et al., *Gene* 104:1 (1991); Tomb, *J. Proc. Natl. Acad. Sci. U.S.A.* 89:10252 (1992)). Six of the genes, comA to comF, comprise an operon which is under positive control by a 22-bp palindromic competence regulatory element (CRE) about one helix turn upstream of the promoter. The rec-2 transformation gene is also controlled by this element. It is now possible to locate additional copies of CRE in the genome and discover potential transformation genes under CRE control. In addition, it may now be possible to discover other global regulatory elements with an ease not previously possible.

One well-described gene regulatory system in bacteria is the "two-component" system composed of a sensor molecule that detects some sort of environmental signal and a regulator molecule that is phosphorlated by the activated form of the sensor. The regulator protein is generally a transcription factor which, when activated by the sensor, turns on or off expression of a specific set of genes (for review, see Albright et al., *Ann. Rev. Genet.* 23:311 (1989); Parinson and Kofold, *Ann. Rev. Genet.* 26:71 (1992). It has been estimated that *E. coli* harbors 40 sensor-regulator pairs (Albright et al., *Ann. Rev. Genet.* 23:311 (1989); Parkinson and Kofold, *Ann. Rev. Genet.* 26:71 (1992)). The *H. influenaze* genome was searched with representative proteins from each family of sensor and regulator proteins using tblasts and tfasta. Four sensor and five regulator proteins were identified with similarity to proteins from other species (Table 6). There appears to be a corresponding sensor for each regulator protein except CpxR. Searches with the CpxA protein from *E. coli* identified three of the four sensors listed in Table 6, but no additional significant matches were found. It is possible that the level of sequence similarity is low enough to be undetectable with tfasts. No representatives of the NtrC-class of regulators were found. This class of proteins interacts directly with the sigma-54 subunit of RNA polymerase, which is not present in *H. influenaze*. All of the regulator proteins fall into the OmpR subclass (Albright et al., *Ann. Rev. Genet.* 23:311 (1989); Parkinson and Kofold, *Ann. Rev. Genet.* 26:71 (1992)). The phoBR and basRS genes of *H. influenaze* are adjacent to one another and presumably form an operon. The nar and arc genes are not located adjacent to one another.

Figure 7:
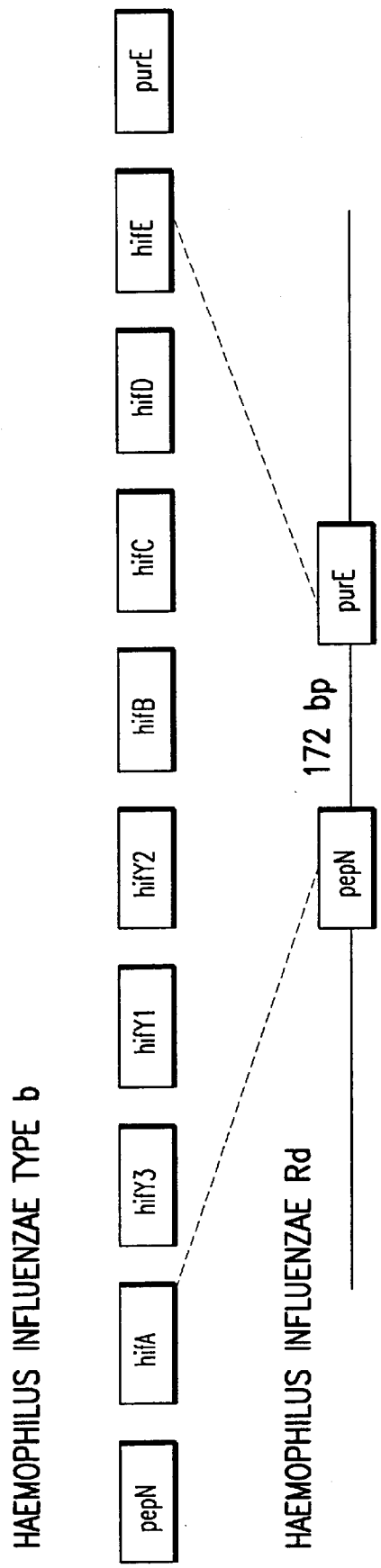
FIG. 7—A comparison of the region of the *H. influenzae* chromosome containing the 8 genes of the fimbrial gene cluster present in *H. influenzae* type b and the same region in *H. influenzae* Rd. The region is flanked by the pepN and purE genes in both organisms. However in the non-infectious Rd strain the 8 genes of the fimbrial gene cluster have been excised. A 172 bp spacer region is located in this region in the Rd strain and continues to be flanked by the pepN and purE genes.

Some of the most interesting questions that can be answered by a complete genome sequence relate to what genes or pathways are absent. The non-pathogenic *H. influenaze* Rd strain varies significantly from the pathogenic serotype b strains. Many of the differences between these two strains appear in factors affecting infectivity. For example, the eight genes which make up the fimbrial gene cluster (vanHam et al., *Mol. Microbio.* 13:673 (1994)) involved in adhesion of bacteria to host cells are now shown to be absent in the Rd strain. The pepN and purE genes which flank the fimbrial cluster in *H. Influenaze* type b strains are adjacent to one another in the Rd strain (FIG. 7), suggesting that the entire fimbrial duster was excised. On a broader level, we determined which *E. coli* proteins are not in *H. influenaze* by taking advantage of a non-redundant set of protein coding genes from *E. coli*, namely the University of Wisconsin Genome Project contigs in GenBank: 1,216 predicted protein sequences from GenBank accessions D10483, L10328, U00006, U00039, U14003, and U18997 (Yurs, etl al., *Nucleic Acids Research* 20:3305 (1992); Burland et al., *Genomics* 16:551 (1993)). The minimum threshold for matches was set so that even weak matches would be scored as positive, thereby giving a minimal estimate of the *E. coli* genes not present in *H. influenaze*. tBlasts was used to search each of the *E. coli* proteins against the complete genome. All blast scores >100 were considered matches. Altogether 62 *E. coli* proteins matched at least one region of the *H. influenaze* genome and 589 proteins did not. The 589 non-matching proteins were examined and found to contain a disproportionate number of hypothetical proteins from *E.* coli. Sixty-eight percent of the identified *E. coli* proteins were matched by an *H. influenaze* sequence whereas only 38% of the hypothetical proteins were matches. Proteins are annotated as hypotetical based on a lack of matches with any other known protein (Yurs et al., *Nucleic Acids Research* 20:3305 (1992); Burland et al., *Genomics* 16:551 (1993)). At least two potential explanations can be offered for the over representations of hypothetical proteins among those without matches: some of the hypothetical proteins are not, in fact, translated (at least in the annotated frame), or these are *E. coli*-specific proteins that are unlikely to be found in any species except those most closely related to *E. coli*, for example *Salmonella typhimurium*.

A total of 384 predicted coding regions did not display significant similarity with a six-frame translation of GenBank release 87. Several novel gene families were identified. For example, two predicted coding regions without database matches (H10591, H10852) share 75% identity over almost their entire lengths (139 and 143 amino acid residues respectively). Their similarity to each other but failure to match any protein available in the current databases suggest that they could represent a novel cellular function.

Figure 8:
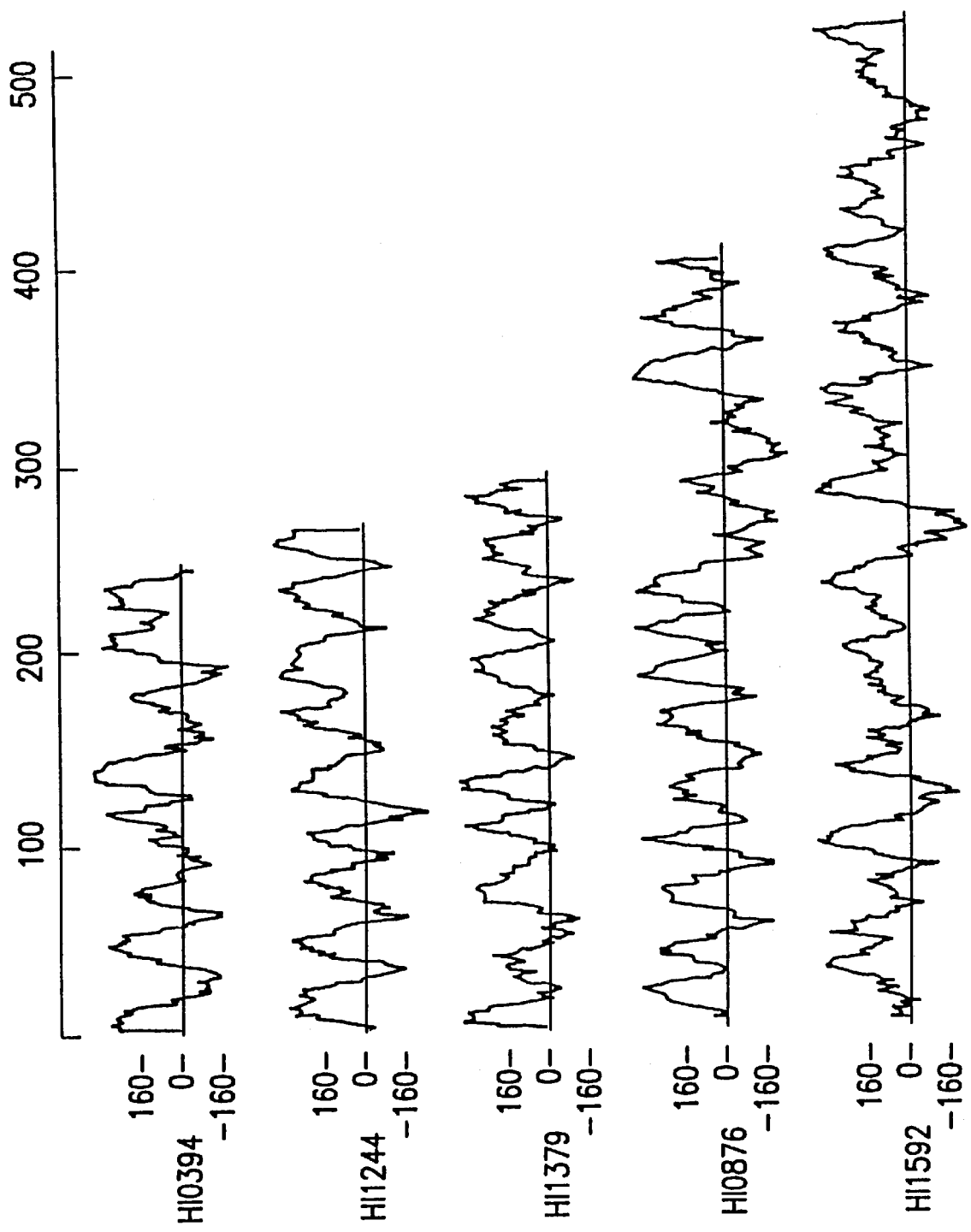
FIG. 8—Hydrophobicity analysis of five predicted channel-proteins. The amino acid sequences of five predicted coding regions that do not display homology with known peptide sequences (GenBank release 87), such exhibit multiple hydrophobic domains that are characteristic of channel-forming proteins. The predicted coding region sequences were analyzed by the Kyte-Doolittle algorithm (Kyte and Doolittle, *J. Mol. Biol.* 157:105 (1982)) (with a range of 11 residues) using the GeneWorks software package (Intelligenetics).

Other types of analyses can be applied to the unidentified coding regions, including hydropathy analysis, which indicates the patterns of potential membrane-spanning domains that are often conserved between members of receptor and transporter gene families, even in the absence of significant amino acid identity. Five examples of unidentified predicted coding regions that display potential transmembrane domains with a periodic pattern that is characteristic of membrane-bound channel proteins are shown in FIG. 8. Such information can be used to focus on specific aspects of cellular function that are affected by targeted deletion or mutation of these genes.

Interest in the medically important aspects of *H. influenaze* biology has focused particularly on those genes which determine virulence characteristics of the organism. Recently, the catalase gene was characterized and sequenced as a possible virulence-related gene (Bishai et al., *J. Bacteriol.* 176:2914 (1994)). A number of the genes responsible for the capsular polysaccharide have been mapped and sequenced (Kroll et al., *Mol. Microbiol.* 5(6):1549 (1991)). Several outer membrane protein genes have been identified and sequenced (Langford et al., *J. Gen. Microbiol.* 138:155 (1992)). The lipooligosaccharide component of the outer membrane and the genes of its synthetic pathway are under intensive study (Weiser et al., *J. Bacteriol.* 173:3304 (1990)). While a vaccine is available, the study of outer membrane components is motivated to some extent by the need for improved vaccines.

Data Availability

The *H. influenaze* genome sequence has been deposited in the Genome Sequence DataBase (GSDA) with the accession number L42023. The nucleotide sequence and peptide translation of each predicted coding region with identified start and stop condons have also been accessioned by GSDB.

Production of an Antibody to a *Haemophilus influenzae* Protein

Substantially pure protein or polypeptide is isolated from the transfected or transformed cells using any one of the methods known in the art. The protein can also be produced in a recombinant prokaryotic expression system, such as *E. coli*, or can by chemically synthesized. Concentration of protein in the final preparation is adjusted, for example, by concentration on an Amicon filter device, to the level of a few micrograms/ml. Monoclonal or polyclonal antibody to the protein can then be prepared as follow:

Monoclonal Antibody Production by Hybridoma Fusion

Monoclonal antibody to epitopes of any of the peptides identified and isolated as described can be prepared from murine hybridomas according to the classical method of Kohler, G. and Milstein, C., *Nature* 256:495 (1975) or modifications of the methods thereof. Briefly, a mouse is repetitively inoculated with a few micrograms of the selected protein over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopteria (HAT media). The successfully fused cells are diluted and aliquots of the dilution placed in wells of a microtiter plate where growth of the culture is continued. Antibody producing clones are identified by detection of antibody in the supernatant fluid of the wells by immunoassay procedures, such as ELISA, as originally described by Engvall, E., *Meth. Enzymol.* 70:419 (1980), and modified methods thereof. Selected positive clones can be expanded and their monoclonal antibody product harvested for use. Detailed procedures for monoclonal antibody production are described in Davis, L. et al. Basic Method in Molecular Biology Elsevier, N.Y. Section 21-2 (1989).

Polyclonal Antibody Production by Immunization

Polyclonal antiserum containing antibodies to heterogenous epitopes of a single protein can be prepared by immunizing suitable animals with the expressed protein described above, which can be unmodified or modified to enhance immunogenicity. Effective polyclonal antibody production is affected by many factors related both to the antigen and the host species. For example, small molecules tend to be less immunogenic that other and may require the use of carriers and adjuvant. Also, host animals vary in response to site of inoculations and dose, with both inadequate or excessive doses of antigen resulting in low titer antisers. Small doses (ng level) of antigen administered at multiple intradermal sites appears to be most reliable. An effective immunization protocol for rabbits can be found in Vaitukaitis, J. et al., *J. Clin. Endocrinol. Metab.* 33:988–991 (1971).

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, O. et al., Chap. 19 in: *Handbook of Experimental Immunology*, Wier, D., ed, Blackwell (1973). Plateau concentration of antibody is usually in the range of 0.1 to 0.2 mg/ml of serum (about 12 $\mu$M). Affinity of the antisera for the antigen is determined by preparing competitive binding curves, as described, for example, by Fisher, D., Chap. 42 in: *Manual of Clinical Immunology*, second edition, Rose and Friedman, eds., Amer. Soc. For Microbiology, Washing D.C. (1980).

Antibody preparations prepared according to either protocol are useful in quantitative immunoassays which determine concentrations of antigen-bearing substances in biological samples; they are also used semi-quantitatively or qualitatively to identify the presence of antigen in a biological sample Preparation of PCR Primers and Amplification of DNA Various fragments of the *haemophilus influenzae* Rd genome, such as those disclosed in Tables 1(a) and 2 can be used, in accordance with the present invention, to prepare PCR primers for a variety of uses. The PCR primers are preferably at least 15 bases, and more preferably at least 18 bases in length. When selecting a primer sequence, it is preferred that the primer pairs have approximately the same G/C ratio, so that melting temperatures are approximately the same. The PCR primers and amplified DNA of this Example find use in the Examples that follow.

Gene expression from DNA Sequences Corresponding to ORFs

A fragment of the *Haemophilus influenzae* Rd genome provided in Tables 1(a) or 2 is introduced into an expression vector using conventional technology. (Techniques to transfer cloned sequences into expression vectors that direct protein translation in mammalian, yeast, insect or bacterial expression systems are well known in the art.) Commercially available vectors and expression systems are available from a variety of suppliers including Stratagene (La Jolla, Calif.), Promega (Madison, Wis.), and Invitrogen (San Diego, Calif.). If desired, to enhance expression and facilitate proper protein folding, the codon context and codon pairing of the sequence may be optimized for the particular expression organism, as explained by Hatfield et al., U.S. Pat. No. 5,082,767, incorporated herein by this reference.

The following is provided as one exemplary method to generate polypeptide(s) from cloned ORFs of the Haemophilus genome fragment. Since the ORF lacks a poly A sequence because of the bacterial origin of the ORF, this sequence can be added to the construct by, for example, splicing out the poly A sequence from pSG5 (Stratagene) using BglI and SalI restriction endonclease enzymes and incorporating it into the mammalian expression vector pXTI (Stratagene) for use in eukaryotic expression systems. pXTI contains the LTRs and a portion of the gag gene from Moloney Murine Leukemia Virus. The position of the LTRs in the construct allow efficient stable transfection. The vector includes the Herpes Simplex thymidine kinase promoter and the selectable neomycin gene. The Haemophilus DNA is obtained by PCR from the bacterial vector using oligonucleotide primers complementary to the Haemophilus DNA and containing restriction endonuclease sequences for PstI incorporated into the 5' primer and BglII at the 5' end of the corresponding Haemophilus DNA 3' primer, taking care to ensure that the Haemophilus DNA is positioned such that its followed with the poly A sequence. The purified fragment obtained from the resulting PCR reaction is digested with PstI, blunt ended with an exonuclease, digested with BglII, purified with ligated to pXTI, now containing a poly A sequence and digested BgtII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 ug/ml G418 (Sigma, St. Louis, Mo.). The protein is preferably released into the supernatant. However if the protein has membrane binding domains, the protein may additionally be retained within the cell or expression may be restricted to the cell surface.

Since it may be necessary to purify and locate the transfected product, synthetic 15-mer peptides synthesized from the predicted Haemophilus DNA sequence are injected into mice to generate antibody to the polypeptide encoded by the Haemophilus DNA.

If antibody production is not possible, the Haemophilus DNA sequence is additionally incorporated into eukaryotic expression vectors and expressed as a chimeric with for example, β-globin. Antibody to β-globin is used to purify the chimeric. Corresponding protease cleavage sites engineered between the β-globin gene and the Haemophilus DNA are then used to separate the two polypeptide fragments from one another after translation. One useful expression vector for generating β-globin chimerics in P6G5 (Stragagene). This vector encodes rabbit β-globin. Intron II of the rabbit β-globin gene facilitates splicing of the expressed transcript, and the polyadenylation signal incorporated into the construct increases the level of expression. These techniques as described are well known to those skilled in the art of molecular biology. Standard methods are published in methods texts such as Davis et al. and many of the methods are available from the technical assistance representatives from Stratagene, Life Technologies, Inc., or Promega. Polypeptide may additionally be produced from either construct using in vitro translation systems such as in vitro Express™ Translation Kit (Stratagene).

While the present invention has been described in some detail for purposes of clarity and understanding, one skilled in the art will appreciate that various changes in form and detail can be made without departing from the true scope of the invention.

All patents, patent applications and publications referred to above are hereby incorporated by reference.

Amino acid biosynthesis

Glutamate family

| | | | | | | |
|---|---|---|---|---|---|---|
| HI0190 | 202698 | 204044 | flutamate dehydrogenase (gdhA) (*Escherichia coli*) | 74.1 | 84.4 | 446 |
| HI0667 | 915793 | 917833 | glutamine synthetase (glnA) (*Proteus vulgens*) | 70.7 | 85.9 | 467 |
| HI1725 | 1792409 | 1799821 | undylyl transferase (glnD) (*Escherichia coli*) | 46.6 | 67.8 | 854 |
| HI0613 | 661610 | 860240 | argininosuccinate lyase (arginosuccinase) (seal) (argH) (*Escherichia coli*) | 73.5 | 84.5 | 457 |
| HI1733 | 1799112 | 1800443 | argininosuccinate synthetase (argG) (*Escherichia coli*) | 78.6 | 87.5 | 738 |
| HI0598 | 618753 | 617752 | ornithine carbemoyltransferase (arcB) (*Pseudornones sreuginoes*) | 62.3 | 90.7 | 334 |
| HI1242 | 1313013 | 1311753 | gamma-glutamyl phosphate reductase (proA) (*Escherichia coli*) | 61.7 | 79.4 | 406 |
| HI0902 | 955516 | 956621 | glutamate 5-kinase (gmma-glutamyl lunase) (proB) (*Escherichia coli*) | 65.7 | 80.2 | 363 |

Asperate family

| | | | | | | |
|---|---|---|---|---|---|---|
| HI0288 | 319209 | 320419 | aspartate amminotransferase (aspC) (*Bacillus* sp.) | 31.1 | 53.8 | 349 |
| HI1623 | 1684147 | 1685334 | aspartate anubitrabsferase (aspC) (*Escherichia coli*) | 62.6 | 79.0 | 396 |
| HI0566 | 582379 | 583366 | asparagine synthetase A (asnA) (*Escherichia coli*) | 63.3 | 77.0 | 330 |
| HI0648 | 690744 | 689632 | aspartate-semialdehyde dehydrogenese (aes) (*Escherichia coli*) | 71.9 | 84.9 | 367 |
| HI1311 | 1385700 | 1386509 | dehydrodipicolnate reductse (dapB) (*Escherichia coli*) | 70.3 | 82.5 | 269 |
| HI0729 | 779456 | 778212 | diaminopomelete decarboxylase (dep decarboxylase) (lysA) (*Pseudomones seruginose*) | 57.6 | 78.6 | 413 |
| HI0752 | 810250 | 811071 | diaminopimelete epimerase (dapF) (*Escherichia coli*) | 77.0 | 85.8 | 274 |
| HI0258 | 284972 | 285865 | dehydrodapicotnate synthetase (dapA) (*Escherichia coli*) | 85.2 | 79.8 | 292 |

-continued

| | | | | | | |
|---|---|---|---|---|---|---|
| HI1638 | 1693968 | 1694330 | lysine-senarine aspartokinase ill (lysC) (*Escherichia coli*) | 55.3 | 73.2 | 449 |
| HI0102 | 109226 | 106096 | succinyl-diaminopimalate desuccinylase (dagE) (*Echerichia coli*) | 61.6 | 79.7 | 374 |
| HI1640 | 1696728 | 1695820 | tetrahydrodipirolinate N-succinyltransferase (dspD) (*Actinobacillus pleuropneumonase* | 96.7 | 98.5 | 273 |
| HI0089 | 96280 | 93836 | sapertokinase-homoserine dehydrogenese (xhrA) (*Serratia merceacene*) | 62.2 | 77.4 | 814 |
| HI0068 | 93820 | 92879 | homosenne lonase (thrR) (*Serratia mercescens*) | 61.8 | 80.6 | 306 |
| HI0087 | 92833 | 91559 | threonine synthase (thrC) (*Serratia mercescens*) | 67.0 | 80.9 | 425 |
| HI1044 | 1107725 | 1105876 | B12-dependent homocysteine-N5-methyltetrahydrofolate transmethylase (metH) (*Escherchia coli*) | 54.2 | 70.4 | 1217 |
| HI0122 | 137942 | 136745 | beta-cystathionase (metC) (*Escherichia coli*) | 65.4 | 84.1 | 390 |
| HI0066 | 90743 | 69601 | cystathione gamma-synthase (metB) (*Escherichia coli*) | 41.9 | 62.2 | 374 |
| HI1266 | 1339983 | 1341056 | homosenne acetyltransferase (met2) (*Saccharomyces careviase*) | 38.1 | 57.1 | 387 |
| HI1708 | 1773485 | 1771221 | tetrahydropteroyltriglutamate methyltransferase (metE) (*Escherichia coli*) | 52.4 | 68.0 | 747 |
| Senne family | | | | | | |
| HI0891 | 942366 | 943628 | senne hydroxymethyltransferase (senne methylase) (glyA) (*Actinobacillus actinomycetemcomitans*) | 85.7 | 93.6 | 419 |
| HI0467 | 486594 | 487823 | phosphoglycerate dehydrogenase (serA) (*Escherichia coli*) | 71.1 | 83.9 | 408 |
| HI1170 | 1238587 | 1237502 | phosphosenne aminotransferase (serC) (*Escherichia coli*) | 53.4 | 72.3 | 358 |
| HI1035 | 1097573 | 1096814 | phosphosenne phosphatase (o-phosphosenne phosphohydrolase) (serB) (*Escherichia coli*) | 52.3 | 69.5 | 303 |
| HI1105 | 1165130 | 1166077 | cysteine synthetase (cysK) (*Escherichia coli*) | 70.0 | 83.9 | 309 |
| HI0608 | 636187 | 636987 | serine acetyltransferase (cysE) (*Escherichia coli*) | 73.0 | 88.3 | 256 |
| Aromatic amino acid family | | | | | | |
| HI0972 | 1026936 | 1027382 | 3-dehydroquinase (aroQ) (*Actinobacillus pleuropneumoniase*) | 67.1 | 82.5 | 143 |
| HI0209 | 222169 | 223254 | 3-dehydroquinate synthase (aroB) (*Escherichia coli*) | 62.1 | 76.7 | 356 |
| HI0197 | 211424 | 212494 | chorismate synthase (aroC) (*Escherichia coli*) | 77.3 | 88.4 | 350 |
| HI0609 | 637000 | 637812 | dehydroquinase shilumate dehydrogenase (*Nicotiana tabacum*) | 30.0 | 51.5 | 242 |
| HI1595 | 1656463 | 1657758 | enolpyruvylshilumatephosphatesynthase (aroA) (*Haemophilus influenzae*) | 97.7 | 98.4 | 432 |
| HI0857 | 698939 | 698124 | shilumate 5-dehydrogenase (aroE) (*Escherichia coli*) | 49.1 | 70.1 | 270 |
| HI0206 | 221607 | 222146 | shilomic acid lanase I (aroK) (*Escreichia coli*) | 75.0 | 87.5 | 104 |
| HI1148 | 1213767 | 1214921 | chonamate mutase/prophonate dehydratase phsA polypeptide (phsA) (*Escherichia coli*) | 54.3 | 74.7 | 375 |
| HI1553 | 1618339 | 1617254 | DAHP synthetase (phenylalanine repressible) (aroG) (*Escherichia coli*) | 72.0 | 83.8 | 345 |
| HI1293 | 1370448 | 1371578 | chorismate mutase (tyrA) (*Erwina herbicola*) | 59.6 | 76.8 | 366 |
| HI1392 | 1481917 | 1483470 | anthranilate synthase component I (trpE) (*Escherichia coli*) | 52.9 | 73.2 | 494 |
| HI1393 | 1483718 | 1495554 | anthranilate synthase component II (trpD) (*Escherichia coli*) | 56.6 | 74.2 | 452 |
| HI1174 | 1240757 | 1241335 | antrhanilate synthase glutamine amindotransferase )trpG) (*Acimetobacter calcoacebcus*) | 34.0 | 59.0 | 191 |
| HI1437 | 1519794 | 1520597 | tryptophan synthase alpha chain (trpA) (*Salmonella typhimunum*) | 57.8 | 72.6 | 267 |
| HI1436 | 1518601 | 1519791 | trytpophan synthase beta chain (trpB) (*Escherichia coli*) | 82.4 | 90.3 | 391 |
| HI0474 | 494758 | 495354 | amedotransferase (hrsH) (*Escherichia coli*) | 55.9 | 70.3 | 195 |
| HI0470 | 490033 | 490941 | ATP phosphonbosyltransferase (hisG) (*Escherichia coli*) | 72.2 | 82.0 | 295 |
| HI0476 | 496124 | 496897 | hisF cyclase )hisF) (*Escherichia coli*) | 82.0 | 91.0 | 256 |
| HI0472 | 492389 | 493469 | hisbidinol-phosphate aminotransferase (hisC) (*Escherichia coli*) | 60.1 | 77.5 | 351 |
| HI1169 | 1237411 | 1236314 | histindinol-phosphate aminotransferase (hisH) (*Bacillus subtidis*) | 38.7 | 61.0 | 354 |
| HI0473 | 493604 | 494689 | imisaxoleglycerol-phosphate dehydratase (hisB) (*Escherichia coli*) | 65.0 | 80.5 | 353 |
| HI0477 | 496900 | 497562 | phosphorboxyl-AMP cyclohydrolase (hisE) (*Escherichia coli*) | 60.7 | 77.0 | 195 |
| HI0475 | 495393 | 496139 | phosphonbosylformamino-5aminoimidazole carboxamide ribotide momerase (hisA) (*Escherichia coli*) | 62.9 | 77.1 | 245 |
| Pyruvate family | | | | | | |
| HI1581 | 1642613 | 1643692 | slanine racemase, biosynthetic (air) (*Escherichia coli*) | 56.3 | 74.9 | 358 |
| Branched clain family | | | | | | |
| HI0739 | 791174 | 791968 | acetohydroxy acid synthase II (ilvG) (*Escherichia coli*) | 63.6 | 78.5 | 386 |
| HI1591 | 1652923 | 1651205 | acetolactate synthase III large chain (ilvI) (*Escherichia coli*) | 69.1 | 83.9 | 527 |
| HI1590 | 1651202 | 1650714 | acetolactate synthase III small chain (ilvH) (*Escherichia coli*) | 65.6 | 85.0 | 160 |
| HI1196 | 1259031 | 1258003 | branched-chain-amino-acid transamnase (*Salmonella typhimunum*) | 32.9 | 49.6 | 298 |
| HI0740 | 791969 | 793960 | dihydroxyscid dehydrase (ilvD) (*Escherichia coli*) | 77.9 | 89.4 | 614 |
| HI0684 | 723320 | 724795 | ketol-acid reductoisomerase (ilvC) (*Escherichia coli*) | 81.7 | 89.6 | 491 |
| HI0991 | 1047074 | 1047673 | 3-isopropylmalate dehydratase (isopropylmalate isomerase) (leuD) (*Salmonella typhimunum*) | 71.1 | 86.3 | 197 |
| HI0989 | 1044390 | 1045463 | 3-isopropylmalate dehydrogenase (beta-IPM dehydrogenase) (leuB) (*Salmonella typhimunum*) | 68.0 | 80.1 | 353 |
| HI0985 | 1040319 | 1039578 | leuA protein (leuA) (*Haemophilus influenzae*) | 99.5 | 100.0 | 193 |
| Biosynthesis of cofactors, prosthetic groups, carriers | | | | | | |
| Biotin | | | | | | |
| HI1560 | 1625092 | 1623403 | 7,6-diamino-pelargonic acid aminotransferase (bioA) (*Escherichia coli*) | 58.0 | 74.1 | 420 |
| HI1559 | 1623791 | 1622652 | 7-keto-8-aminopelargonic acid synthetase (bioF) (*Bacillus sphaericus*) | 33.5 | 56.3 | 370 |
| HI1557 | 1622004 | 1621225 | biotin biosynthesis; reaction prior to primeloyl CoA (bioC) (*Escherichia coli*) | 28.6 | 48.8 | 151 |
| HI0645 | 687346 | 684672 | biotin sulfoxide reductase (BDS reductase) (bisC) (*Escherichia coli*) | 54.0 | 71.8 | 734 |
| HI1024 | 1085536 | 1056535 | biotin synthetase (bioB) (*Escherichia coli*) | 59.6 | 77.5 | 307 |
| HI1556 | 1621212 | 1620640 | dethiobiotin synthase (bioD) (*Bacillus sphaericu*) | 42.1 | 59.6 | 175 |
| HI1449 | 1532932 | 1532207 | dethiobiotin synthase (bioD) (*Escherichia coli*) | 41.3 | 62.4 | 217 |

-continued

Folic acid

| | | | | | | |
|---|---|---|---|---|---|---|
| HI1448 | 1531237 | 1532112 | 5,10 methylenetetrahydrofolate reductase (metF) (*Escherichia coli*) | 72.8 | 83.4 | 290 |
| HI0611 | 640325 | 639480 | 5,10-methylene-tetrahydrofolate dehydrogenase (folD) (*Escherichia coli*) | 67.6 | 82.0 | 278 |
| HI0064 | 67257 | 67760 | 7,8-dehydro-6-hydroxymethylpterin-pyrophosphokinase (folK) (*Escherichia coli*) | 56.3 | 77.8 | 158 |
| HI0459 | 478432 | 477392 | aminodeoxychonamate lyase (pabC) (*Escherichia coli*) | 40.1 | 66.5 | 243 |
| HI1635 | 1691986 | 1691351 | dedA protein )dedA) (*Escherichia coli*) | 30.4 | 55.1 | 158 |
| HI0901 | 955417 | 954938 | dehydrolotate reductase, type I (totA) (*Echerichia coli*) | 83.2 | 99.4 | 158 |
| HI1338 | 1412130 | 1412954 | dihydropieroate synthase (folP) (*Escherichia coli*) | 54.5 | 70.9 | 275 |
| HI1468 | 1547398 | 1548370 | dihydropieroate synthase (folP) (*Escherichia coli*) | 54.5 | 70.9 | 275 |
| HI1264 | 1337544 | 1338854 | folylpolyglutamate synthase (folC) (*Escherichia coli*) | 51.7 | 68.4 | 409 |
| HI1451 | 1534018 | 1533365 | GTP cyclohydrolase I (folE) (*Escherichia coli* | 63.9 | 79.0 | 219 |
| HI1173 | 1240715 | 1239732 | p-aminobenzoate synthetase (pabB) (*Escherichia coli*) | 31.0 | 53.6 | 257 |

Lipoate

| | | | | | | |
|---|---|---|---|---|---|---|
| HI0026 | 28810 | 27651 | lipoate biosynthesis protein A (lipA) (*Escherichia coli*) | 73.8 | 84.1 | 321 |
| HI0027 | 29302 | 28667 | lipoate biosynthesis protein B (lipB) (*Escherichia coli*) | 86.7 | 84.2 | 181 |

Molybdoptenn

| | | | | | | |
|---|---|---|---|---|---|---|
| HI1661 | 1743523 | 1743044 | moe C protein (moeC) (*Escherichia coli*) | 79.1 | 89.2 | 157 |
| HI1882 | 1744628 | 1743618 | molybdenum cofactor biosynthesis proten A (mosA) (*Escherichia coli*) | 61.8 | 78.3 | 327 |
| HI1373 | 1461582 | 1461376 | molybdenum-plenn binding protein (mopI) (*Clostridum pesteurianum*) | 51.5 | 74.2 | 66 |
| HI1680 | 1743078 | 1742797 | molybdoplenn (MPT) converting factor, subunit 1 (mobD) (*Escherichia coli*) | 59.3 | 79.0 | 81 |
| HI1452 | 1534156 | 1535367 | molybdopleen biosynthesis protein (chiE) (*Escherichia coli*) | 56.4 | 72.5 | 403 |
| HI0118 | 132351 | 133133 | molybdopleen biosynthesis protein (chiE) (*Escherichia coli*) | 27.9 | 52.9 | 135 |
| HI1453 | 1535374 | 1536102 | molybdopleen biosynthesis protein (chiE) (*Escherichia coli*) | 63.9 | 75.4 | 241 |
| HI1679 | 1742793 | 1742344 | molybdopleen converting factor, subunit 2 (mosE) (*Escherichia coli*) | 58.0 | 75.0 | 150 |
| HI0646 | 692779 | 692204 | molybdopleen-guanine dinucleotide (mob) (*Escherichia coli*) | 39.4 | 61.7 | 187 |

Pantothenate

| | | | | | | |
|---|---|---|---|---|---|---|
| HI0633 | 670482 | 669530 | antothenate lanase (cosA) (*Escherichia coli*) | 64.1 | 78.2 | 314 |

Pyndoxine

| | | | | | | |
|---|---|---|---|---|---|---|
| HI0665 | 913165 | 913851 | pyndoxamine phosphate oxxdase (pdxH) (*Escherichia coli*) | 46.0 | 55.3 | 213 |

Riboflavin

| | | | | | | |
|---|---|---|---|---|---|---|
| HI0766 | 827249 | 827893 | 3,4-dihydroxy-2-butanone 4-phosphate sunthase (nbB) (*Escherichia coli*) | 69.6 | 82.7 | 213 |
| HI0213 | 225991 | 226662 | GTP cyclohydrolase II (rbA) (*Escherichia coli*) | 68.0 | 81.4 | 193 |
| HI0946 | 1002768 | 1003883 | riboflavin biosynthesis protein RtBG (rbD) (*Escherichia coli*) | 87.9 | 76.5 | 361 |
| HI1619 | 1678899 | 1679510 | riboflavin synthase alha chain (ribC) (*Escherichia coli*) | 65.5 | 82.3 | 203 |
| HI1306 | 1382553 | 1383071 | riboflavin synthase beta chain (ribE) (*Escherichia coli*) | 76.3 | 69.7 | 158 |

Thioredoxin, glutaredoxin, glutathione

| | | | | | | |
|---|---|---|---|---|---|---|
| HI0152 | 177496 | 176129 | glutathinone reductase (gor) (*Escherichia coli*) | 74.2 | 85.0 | 450 |
| HI1118 | 1181697 | 1181197 | thioredoxin (trzA) (*Anabeens* sp.) | 36.6 | 58.5 | 82 |
| HI1162 | 1228652 | 1228002 | thioredoxin (trzA) (*Anabeens* sp.) | 33.3 | 61.5 | 39 |
| HI0064 | 88470 | 88150 | thioredoxin n (trxM) (*Anecystis redulena*) | 53.3 | 79.4 | 107 |

Manequinons, ubiquinone

| | | | | | | |
|---|---|---|---|---|---|---|
| HI0265 | 317768 | 316062 | 2-succinyl-6-hydroxy-2,4-cyclohexadiene-1-carbosyalte synthase (menD) (*Escherichia coli*) | 46.8 | 64.4 | 551 |
| HI0971 | 1025835 | 1026875 | 4-(2'-carboxyphenyl)-4-oxybutyric acid synthase (menC) (*Escherichia coli*) | 57.3 | 74.2 | 312 |
| HI1192 | 1256548 | 1255916 | coenzyme PQQ synthesis protein III (pqq#1) (*Acinetobacter celcosostious*) | 25.4 | 49.6 | 211 |
| HI0970 | 1024963 | 1025817 | DHNA synthase (menB) (*Escherichia coli*) | 56.7 | 95.1 | 285 |
| HI1442 | 1525823 | 1526707 | laurnesyldiphosphate synthase (ispA) (*Escherichia coli*) | 53.8 | 71.2 | 297 |
| HI0195 | 206694 | 208049 | o-succinylbenzoate-CoA synthase (menE) (*Escherichia coli*) | 46.0 | 56.8 | 426 |

Heme, prophyrin

| | | | | | | |
|---|---|---|---|---|---|---|
| HI1163 | 1229908 | 1228940 | lerrocheistase (visA) (*Escherichia coli*) | 31.8 | 69.4 | 315 |
| HI0113 | 119848 | 122079 | leme ublization protein (hzuC) (*Haemophilus influenzae*) | 26.4 | 46.1 | 695 |
| HI0265 | 293930 | 285624 | heme-hemopexin ulinaztion (hzuB) (*Heamophilus influenzae*) | 96.1 | 96.9 | 565 |
| HI0804 | 831034 | 829751 | hernY Protein (hemY) (*Escherichia coli*) | 38.9 | 64.4 | 365 |
| HI0485 | 484621 | 485769 | oxygen-independent coproporphyrinogen III oxidase (hemN) (*Salmonella typhimunium*) | 31.5 | 52.3 | 241 |
| HI1204 | 1267418 | 1256477 | protoporphyrinogen oxidase (hemG) (*Escherichia coli*) | 36.1 | 56.8 | 153 |
| HI1565 | 1629849 | 1628974 | protoprophtrinogen oxidase (hemG) (*Escherichia coli*) | 59.1 | 72.6 | 203 |
| HI0605 | 631035 | 632562 | uroporphytrinogen III methylase (hemX) (*Escherichia coli*) | 39.9 | 60.3 | 358 |

Cell envelope

Membranes, lipoproteins, ponne

| | | | | | | |
|---|---|---|---|---|---|---|
| HI1585 | 1647711 | 1647247 | 15 kd peptidoglycan-associated lipoprotein (lpp) (pi Heamophilus influenzae) | 94.6 | 95.5 | 154 |
| HI0622 | 653682 | 652864 | 28 kDa membrane protein (hlpA) (*Haemophilus influenzae*) | 99.6 | 100.0 | 273 |
| HI0304 | 335684 | 337249 | apolipoprotein N-acyltransferase (cuts) (*Escherichia coli*) | 45.2 | 64.1 | 497 |
| HI0362 | 384880 | 384035 | hydrophobic membrane protein (*Streptococcus gordorm*) | 37.2 | 66.5 | 266 |
| HI0409 | 428260 | 427478 | hydrophobic membrane protein (*Streptococcus gordorm*) | 34.4 | 61.3 | 254 |
| HI1573 | 1634553 | 1636106 | iron-regulated outer membrane protein A (iroA) (*Neissene meningitidis*) | 28.9 | 50.9 | 398 |
| HI0695 | 736825 | 737846 | lipoprotein (hel) (*Haemophilus influenzae*) | 99.6 | 99.6 | 274 |

-continued

| | | | | | | |
|---|---|---|---|---|---|---|
| HI0707 | 749215 | 750429 | lipoprotein (nlpD) (*Escherichia coli*) | 48.6 | 84.8 | 364 |
| HI0705 | 748419 | 748994 | lipoprotein B (lppB) (*Haemophilus somnus*) | 72.3 | 589.5 | 191 |
| HI0896 | 946675 | 947916 | membrane fusion protein (mtrC) (*Neiseene gonorrhosse*) | 30.9 | 53.6 | 337 |
| HI0403 | 421547 | 422923 | outer membrane protein P1 (ompP1) (*Haemophilus influenzae*) | 93.0 | 97.2 | 459 |
| HI0140 | 153446 | 154522 | outer membrane protein P2 (ompP2) (*Haemophilus influenzae*) | 96.7 | 97.5 | 361 |
| HI1167 | 1234699 | 1235757 | outer membrane protein P5 (ompA) (*Haemophilus influenzae*) | 94.1 | 95.8 | 353 |
| HI0906 | 958203 | 958901 | prolipoprotein diacylglyceryl transferase (lgt) (*Escherichia coli*) | 62.5 | 80.1 | 285 |
| HI0030 | 31698 | 30838 | rare lipoprotein A (rlpA) (*Escherichia coli*) | 34.5 | 57.8 | 288 |
| HI0924 | 979182 | 979727 | rare lipoprotein B (rlpB) (*Escherichia coli*) | 33.5 | 62.1 | 163 |
| Surface polysaccharides, lipopolysaccharides & antigens | | | | | | |
| HI1582 | 1628153 | 1627302 | 2-dehydro-3-deoxyphosphooctonate aklolase (kdsA) (*Escherichia coli*) | 81.3 | 91.5 | 283 |
| HI0654 | 696743 | 695463 | 2-deoxy-d-manno-octuloeonic-acid transferase (kdtA) (*Escherichia coli*) | 50.7 | 69.9 | 420 |
| HI1108 | 1169716 | 1168139 | ADP-heptose-lps heptosyltransferase II (rlsF) (*Escherichia coli*) | 63.6 | 78.9 | 345 |
| HI1117 | 1181141 | 1180218 | ADP-L-glycero-D-mannoheptose-6-epimerase (rfaD) (*Escherichia coli*) | 78.2 | 87.7 | 308 |
| HI0058 | 59659 | 58898 | CTP:CMP-3-deoxy-D-manno-octulosonate-cylidylyl-transferase (kdsB) (*Escherichia coli*) | 65.0 | 81.7 | 245 |
| HI0917 | 970233 | 969211 | firA protein (firA) (*Pasteurella mulocula*) | 84.9 | 91.1 | 338 |
| HI0870 | 919974 | 920723 | glycosyl transferase (lgtD) (*Nerseens gonorrhosse*) | 30.3 | 55.3 | 200 |
| HI1584 | 1646090 | 1647058 | glycosyl transferase (lgtD) (*Nerseens gonorrhosse*) | 47.3 | 64.0 | 328 |
| HI0653 | 695453 | 694996 | KDTB protein (kdtD) (*Escherichia coli*) | 52.3 | 75.8 | 153 |
| HI1684 | 1746281 | 1747291 | kpaF protein (kpaF) (*Escherichia coli*) | 49.3 | 70.8 | 294 |
| HI1543 | 1607986 | 1608967 | lic-1 operon protein (licA) (*Haemophilus influenzae*) | 99.7 | 100.0 | 321 |
| HI1544 | 1608970 | 1609885 | lic-1 operon protein (licB) (*Haemophilus influenzae*) | 99.0 | 99.3 | 303 |
| HI1545 | 1609845 | 1610543 | lic-1 operon protein (licC) (*Haemophilus influenzae*) | 96.5 | 99.5 | 198 |
| HI1546 | 1610546 | 1611340 | lic-1 operon protein (licD) (*Haemophilus influenzae*) | 88.7 | 94.0 | 265 |
| HI1062 | 1125450 | 1124254 | lipid A disaccharide synthetase (fpxB) (*Escherichia coli*) | 63.2 | 77.3 | 382 |
| HI0552 | 571001 | 570096 | lipooligosaccharide biosynthesis protein (*Haemophilus influenzae*) | 96.3 | 99.0 | 298 |
| HI0767 | 627911 | 628758 | lipooligosaccharide biosynthesis protein (*Haemophilus influenzae*) | 36.4 | 59.5 | 267 |
| HI0869 | 916779 | 919990 | lag locus hypothetical protein (GB:M94855_1) (*Haemophilus influenzae*) | 80.5 | 82.5 | 400 |
| HI1706 | 1770127 | 1768916 | lag locus hypothetical protein (GB:M94855_1) (*Haemophilus influenzae*) | 99.3 | 100.0 | 401 |
| HI1705 | 1788457 | 1768005 | lag locus hypothetical protein (GB:M94855_2) (*Haemophilus influenzae*) | 98.4 | 98.7 | 304 |
| HI1704 | 1768000 | 1767322 | lag locus hypothetical protein (GB:M94855_3) (*Haemophilus influenzae*) | 96.0 | 97.4 | 226 |
| HI1703 | 1766957 | 1766157 | lag locus hypothetical protein (GB:M94855_4) (*Haemophilus influenzae*) | 96.1 | 98.4 | 257 |
| HI1702 | 1766142 | 1765261 | lag locus hypothetical protein (GB:M94855_5) (*Haemophilus influenzae*) | 96.9 | 98.3 | 294 |
| HI1701 | 1765256 | 1764456 | lag locus hypothetical protein (GB:M94855_6) (*Haemophilus influenzae*) | 98.9 | 99.3 | 267 |
| HI1700 | 1763577 | 1764341 | lag locus hypothetical protein (GB:M94855_7) (*Haemophilus influenzae*) | 98.4 | 98.4 | 256 |
| HI1899 | 1763439 | 1762678 | lag locus hypothetical protein (GB:M94855_8) (*Haemophilus influenzae*) | 98.8 | 98.0 | 209 |
| HI0283 | 290317 | 291387 | opsX locus protein (opsX) (*Xanthomones carnpestris*) | 35.2 | 56.7 | 261 |
| HI1722 | 1788457 | 1787483 | rle (CGSC No 294) protein (*Escherichia coli*) | 59.0 | 77.2 | 344 |
| HI1147 | 1212723 | 1213637 | UDP-3-0-acyl N-acetylglcosamine descetylase (envA) *Escherichia coli*) | 77.3 | 88.2 | 304 |
| HI1083 | 1126276 | 1125493 | UDP-N-acetylgluocosemine acetyltransferase (lpsA) (*Escherichia coli*) | 86.0 | 79.4 | 262 |
| HI0675 | 925083 | 926096 | UDP-N-acetylglucosamine epimersase (rlfE) (*Escherichia coli*) | 65.5 | 79.5 | 336 |
| HI0674 | 923609 | 925021 | undecaprenyl-phosphate galactosephosphotransferase (ribP) (*Salmonella typhimunum*) | 57.9 | 75.1 | 495 |
| Surface structures | | | | | | |
| HI1736 | 1806251 | 1804281 | adhesin (andA-I) (*Escherichia coli*) | 29.3 | 45.8 | 1196 |
| HI0119 | 133314 | 134324 | adhesin B precursor (fimA) (*Streptococcus parasanguis*) | 24.5 | 48.3 | 309 |
| HI0364 | 386685 | 385807 | adhesin B precursor (fimA) (*Streptococcus parasanguis*) | 34.6 | 61.6 | 302 |
| HI0332 | 356770 | 368062 | cellenvelope protein (cepA) (*Haemophilus influenzae*) | 99.8 | 100.0 | 431 |
| HI0713 | 757120 | 757425 | flagellar switch protein (ftiM) (*Salmonella typhimunum*) | 34.1 | 61.0 | 41 |
| HI1484 | 1542848 | 1542294 | invesin precursor (outer membrane adhesin) (yopA) (*Yersinia enterocoluica*) | 38.5 | 62.1 | 291 |
| HI0333 | 358125 | 358526 | opacity associated protein (oapB) (*Haemophilus influenzae*) | 99.2 | 99.2 | 132 |
| HI0418 | 436627 | 436636 | opacity protein (opa66) (*Neisseria gonorrhosse*) | 74.5 | 90.9 | 55 |
| HI1177 | 1243585 | 1243947 | opacity protein (opa66) (*Neisseria gonorrhosse*) | 37.7 | 59.0 | 181 |
| HI1461 | 1540805 | 1540272 | opacity protein (opaD) (*Neisseria meningitidis*) | 34.5 | 55.8 | 230 |
| HI0300 | 333052 | 331661 | plin biogeneers protein (pilB) (*Pseudomones seruginosa*) | 44.1 | 64.8 | 485 |
| HI0919 | 973373 | 970950 | protective surface antigen D15 (*Haemophilus influenzae*) | 96.6 | 99.5 | 797 |
| Murein, secculus, peptidoglycan | | | | | | |
| HI1674 | 1737564 | 1735481 | carbosy-terminal protease, penicillin-binding protein 3 (prc) (*Escherichia coli*) | 52.3 | 69.5 | 660 |
| HI1143 | 1208355 | 1209272 | D-alanine-D-sterine ligase (ddB) (*Escherichia coli*) | 58.9 | 75.8 | 303 |
| HI1333 | 1408296 | 1406850 | D-alanyl-D-alanine carbosypeptidase (decB) (*Escherichia coli*) | 43.9 | 68.2 | 454 |
| HI0066 | 68323 | 69618 | N-acetylmuramoyl-L-alanine amidase (amiB) (*Escherichia coli*) | 59.5 | 77.0 | 221 |
| HI0383 | 401990 | 401532 | PC protein (15kd peptidoglycan-associated outer membrane lipoprotein) (pal) (*Haemophilus influenzae*) | 100.0 | 100.0 | 153 |
| HI1731 | 1795566 | 1797908 | penicillin-binding protein 1B (ponB) (*Escherichia coli*) | 47.0 | 67.5 | 767 |
| HI0032 | 34810 | 32858 | penicillin-binding protein 2 (pbp2) (*Escherichia coli*) | 58.8 | 73.8 | 609 |
| HI0029 | 30819 | 29641 | penicillin-binding protein 5 (decA) (*Escherichia coli*) | 54.8 | 68.4 | 362 |
| HI0198 | 212582 | 213439 | penicillin-insensitive murein endopeptidse (mapA) (*Escherichia coli*) | 49.3 | 56.7 | 269 |
| HI1138 | 1201927 | 1203006 | phospho-N-acetylmuramoyl-pentapeptide-transferes E (mrsY) (*Escherichia coli*) | 76.7 | 88.9 | 360 |
| HI0036 | 40689 | 41741 | rod shape-determining protein (mrsC) (*Escherichia coli*) | 50.3 | 74.5 | 293 |
| HI0031 | 32865 | 31753 | rod shape-determining protein (mrsB) (*Escherichia coli*) | 63.1 | 80.7 | 358 |
| HI0037 | 39473 | 40606 | rod shape-determining protein (mrsB) (*Escherichia coli*) | 79.8 | 89.9 | 347 |
| HI0039 | 41744 | 42229 | rod shape-determining protein (mrsD) (*Escherichia coli*) | 40.8 | 71.8 | 154 |
| HI0631 | 878792 | 880570 | soluable lytic mureine transglycosylase (slt) (*Escherichia coli*) | 40.4 | 59.3 | 378 |

| | | | -continued | | | |
|---|---|---|---|---|---|---|
| HI1141 | 1205663 | 1206715 | transferase, peptidoglycan synthesis (murG) (*Escherichia coli*) | 61.7 | 78.0 | 350 |
| HI1137 | 1200560 | 1201930 | UDP-murnec-pentapeptide synthetase (murF) (*Escherichia coli*) | 51.4 | 68.2 | 452 |
| HI1136 | 1199080 | 1200543 | UDP-MurNac-tripeptide synthetase (murE) (*Escherichia coli*) | 55.7 | 72.6 | 463 |
| HI0270 | 301245 | 302267 | UDP-N-acetylenotypruvoylglucosamine reductase (murB) (*Escherichia coli*) | 57.6 | 75.6 | 340 |
| HI1083 | 1148434 | 1147163 | UDP-N-acetylglucosamine enolpyrubyl transferase (murZ) (*Escherichia coli*) | 72.4 | 64.5 | 419 |
| HI1142 | 1206856 | 1208280 | UDP-N-acetylmuramate-alanine ligase (murC) (*Escherichia coli*) | 68.2 | 81.8 | 470 |
| HI1139 | 1203132 | 1204442 | UDP-N-acetylmursmoylalanine-D-glutamate ligase (murD) (*Escherichia coli*) | 61.0 | 73.7 | 437 |
| HI1498 | 1569479 | 1569626 | N-acetylmuramoyl-L-alanine amidase (Bacteriophage T3) | 42.9 | 62.2 | 87 |
| Central intermediary metabolism | | | | | | |
| Phosphorus compounds | | | | | | |
| HI0697 | 739608 | 738640 | exopolyphophatase (ppx) (*Escherichia coli*) | 55.2 | 76.7 | 318 |
| HI0124 | 139861 | 139334 | inorganic pyrophosphatase (ppa) (*Escherichia coli*) | 36.3 | 50.3 | 157 |
| HI0647 | 689574 | 688637 | lysophosphotipase LP (pidB) (*Escherichia coli*) | 31.2 | 53.1 | 217 |
| Sulfur metabolism | | | | | | |
| HI1374 | 1462019 | 1461683 | desulfoviridin gamma subunit (devC) (*Desulfovibrio vulgaris*) | 34.0 | 58.0 | 99 |
| HI0807 | 854438 | 853741 | putative arylsulfatase regulatory protein (salB) (*Escherichia coli*) | 47.4 | 67.0 | 381 |
| HI0561 | 578539 | 577856 | sulfite synthesis pathway protein (cysO) (*Escherichia coli*) | 36.9 | 56.0 | 265 |
| Polyamine biosynthesis | | | | | | |
| HI0099 | 106307 | 107374 | nucleotide binding protein (potG) (*Escherichia coli*) | 42.6 | 66.9 | 340 |
| HI0593 | 614187 | 612028 | ornithine decarboxylase (spoF) (*Escherichia coli*) | 66.4 | 80.2 | 717 |
| Polysaccharides - (cytoplasmic) | | | | | | |
| HI1360 | 1436170 | 1438359 | 1,4-alpha-glucan branching enzyme (glgB) (*Escherichia coli*) | 64.5 | 80.1 | 723 |
| HI1362 | 1440427 | 1441758 | ADP-glucose synthetase )glgC) (*Escherichia coli*) | 55.0 | 74.3 | 407 |
| HI1364 | 1443545 | 1446007 | alpha-glucan phosphorylase (glgC) (*Escherichia coli*) | 61.1 | 79.1 | 809 |
| HI1361 | 1438458 | 1440434 | glycogen operon protein(glgX) (*Escherichia coli*) | 54.3 | 67.8 | 501 |
| HI1363 | 1441868 | 1443296 | glycogen synthease (glgA) (*Escherichia coli*) | 56.2 | 71.2 | 475 |
| Degradation of polysaccharides | | | | | | |
| HI1359 | 1434061 | 1436157 | amylomaltase (malO) (*Escherichia coli*) | 72.1 | 84.3 | 609 |
| HI1420 | 1507662 | 1507063 | emdochitinase (*Oryza saliva*) | 38.9 | 50.9 | 106 |
| Amino sugars | | | | | | |
| HI0431 | 452989 | 451160 | glutamine amidotransferase (glmB) (*Escherichia coli*) | 72.1 | 84.3 | 609 |
| HI0141 | 155859 | 154717 | N-acetylglucosamine-6-phosphate danoetylase (negA) (*Escherichia coli*) | 54.5 | 72.1 | 376 |
| HI0142 | 156944 | 156135 | negB protein (negB) (*Escherichia coli*) | 74.2 | 88.1 | 260 |
| Other | | | | | | |
| HI0048 | 49257 | 48403 | 7-alpha-hydroxysteroid dehydrogenase (hdhA) (*Escherichia coli*) | 32.4 | 55.1 | 24 |
| HI1207 | 1271536 | 1270334 | secrete kinase (ackA) (*Escherichia coli*) | 69.1 | 83.9 | 396 |
| HI0981 | 1009728 | 1008367 | GABA transerminase (gabT)(*Escherichia coli*) | 34.4 | 55.8 | 420 |
| HI0111 | 118858 | 119484 | glutathione transferase (bphH) (*Pseudomones* sp.) | 37.6 | 57.4 | 200 |
| HI0693 | 734488 | 735996 | glycerol kinase (glpK) (*Escherichia coli*) | 76.9 | 89.2 | 502 |
| HI0596 | 608429 | 605161 | hippuricase (hipO) (*Campylobacter jejuni*) | 27.8 | 49.6 | 276 |
| HI0643 | 584874 | 584575 | urease (ureA) (*Helicobacter hetlmannii*) | 62.4 | 76.2 | 101 |
| HI0639 | 581666 | 561087 | urease accessory protein (UraF) (*Bacillus* sp.) | 31.8 | 54.9 | 194 |
| HI0541 | 564179 | 562464 | urease alpha subunit (urea amidohydrolase) (ureC) (*Bacillus* sp.) | 67.3 | 82.1 | 588 |
| HI0640 | 562333 | 561779 | urease protein (ureE) (*Helicobacter pylori*) | 31.01 | 56.9 | 155 |
| HI0538 | 560961 | 560307 | urease protein (ureG) (*Helicobacter pylori*) | 70.7 | 86.9 | 129 |
| HI0537 | 580229 | 559447 | urease protein (ureH) (*Helicobacter pylori*) | 31.5 | 53.9 | 213 |
| HI0542 | 564180 | 546574 | urease subunit B (ureB) (*Escherichia coli*) | 61.6 | 77.6 | 103 |
| Energy metabolism | | | | | | |
| Amino acids, amines | | | | | | |
| HI0536 | 559266 | 557842 | aspertase (aspA) (*Escherichia coli*) | 78.2 | 89.1 | 408 |
| HI0597 | 617739 | 616810 | carbamate kinase (sroC) (*Pseudomones seruginosa*) | 78.3 | 67.7 | 309 |
| HI0747 | 802651 | 803897 | L-aspargainase II (ansB) (*Escherichia coli*) | 70.5 | 81.2 | 329 |
| HI0280 | 323270 | 321807 | L-serine deseminase (sdsA) (*Escherichia coli*) | 68.6 | 83.3 | 454 |
| Sugars | | | | | | |
| HI0620 | 669307 | 868288 | aldose 1-apimerase precursor (mutarotase) (mro) (*Acinetobacter calcoaceticus*) | 36.8 | 54.7 | 326 |
| HI0055 | 55016 | 56197 | D-mannonate hydrolase (uxuA) (*Escherichia coli*) | 72.8 | 85.8 | 394 |
| HI1119 | 1181808 | 1182476 | deoxyribose aldolase (deoC) (*Mycoplasma hominis*) | 49.0 | 68.5 | 200 |
| HI0615 | 644708 | 643299 | fucokinase (fucK) (*Escherichia coli*) | 41.1 | 64.5 | 459 |
| HI0613 | 642828 | 642181 | fuculose-1-phosphate aidolase (fucA) (*Escherichia coli*) | 64.7 | 81.4 | 215 |
| HI1014 | 1075981 | 1076610 | fuculose-1-phosphate aidolase (fucA) (*Escherichia coli*) | 32.9 | 51.8 | 163 |
| HI0821 | 870510 | 869320 | galactokinase (galK) (*Haemophilus influenzae*) | 98.4 | 99.0 | 384 |
| HI0145 | 159883 | 158984 | glucose lunase (gik) (*Streptomyces coelicolor*) | 33.6 | 53.2 | 303 |
| HI0615 | 646595 | 644784 | L-fucoso isomerase (fuci) (*Escherichia coli*) | 69.5 | 84.5 | 583 |
| HI1027 | 1090247 | 1089519 | L-ribulose-phosphate 4-epimerase (arsD) (*Escherichia coli*) | 72.3 | 81.8 | 231 |
| HI1111 | 1173107 | 1171938 | mal inducer biosynthesis blocker (malY) (*Escherichia coli*) | 28.1 | 51.6 | 375 |
| HI0143 | 158111 | 157233 | N-acetylneuraminals tyase (nanA) (*Escherichia coli*) | 36.2 | 61.4 | 291 |
| HI0507 | 521330 | 522247 | ribokinase (rbsK) (*Escherichia coli*) | 58.0 | 74.8 | 302 |

-continued

| | | | | | | |
|---|---|---|---|---|---|---|
| HI1115 | 1177307 | 1178823 | xylose isomerase (xylA) (*Escherichia coli*) | 71.3 | 87.2 | 439 |
| HI1116 | 1178629 | 1180161 | xylulose lunase (xylulonase) (*Escherichia coli*) | 33.1 | 50.0 | 479 |
| Glycolysis | | | | | | |
| HI0449 | 470260 | 469342 | 1-phosphofructokinase (fruK) (*Escherichia coli*) | 55.4 | 74.1 | 304 |
| HI0984 | 1039579 | 1038817 | 6-phosphofructokinase (pfkA) (*Escherichia coli*) | 74.4 | 84.4 | 319 |
| HI0934 | 990636 | 989329 | anoisse (ano) (*Bacilius subtilis*) | 65.9 | 78.5 | 413 |
| HI0526 | 547668 | 546592 | fructose-bisphosphate aidolase (fba) (*Escherichia coli*) | 71.3 | 85.8 | 359 |
| HI1592 | 1643750 | 1645438 | glucose-6-phosphate isomerase (pgi) (*Escherichia coli*) | 76.9 | 88.7 | 546 |
| HI0001 | 1 | 600 | glyceraldehyde-3-phosphate dehydrogenase (gapdH) (*Escherichia coli*) | 85.8 | 90.3 | 133 |
| HI0527 | 648939 | 547782 | phosphoglycerate kinase (pgk) (*Escherichia coli*) | 81.1 | 90.7 | 387 |
| HI0759 | 820852 | 821533 | phosphoglyceromutase (gpmA) (*Zymomonas mobius*) | 58.9 | 74.8 | 222 |
| HI1579 | 1639619 | 1641052 | pyruvate kinase type II (pykA) (*Escherichia coli*) | 77.2 | 87.5 | 480 |
| HI0680 | 719664 | 720452 | triosephosphate isomerase (tpiA) (*Escherichia coli*) | 74.4 | 80.7 | 253 |
| Pyruvate dehydrogenase | | | | | | |
| HI1235 | 1303195 | 1301495 | dihydroliposmide acetyltransferase (aceF) (*Escherichia coli*) | 72.8 | 82.4 | 526 |
| HI0194 | 206108 | 203248 | dihydroliposmide acetyltransferase (acoC) (*Pseudemorias pulida*) | 27.8 | 49.1 | 235 |
| HI1234 | 1301378 | 1299945 | liposmide dehydrogenase (lpdA) (*Escherichia coli*) | 81.8 | 91.6 | 474 |
| HI1238 | 1305918 | 1303261 | pyruvate dehydrogenase (aceE) (*Escherichia coli*) | 68.6 | 84.0 | 888 |
| TCA cycle | | | | | | |
| HI1668 | 1731748 | 1728899 | 2-oxogluterate dehydrogenase (sucA) (*Escherichia coli*) | 69.0 | 80.7 | 930 |
| HI0025 | 27397 | 26393 | acetate:SH-citrate lyase ligase (AMP) (*Klebsiella pneumonise*) | 46.9 | 88.4 | 321 |
| HI0022 | 25179 | 23680 | citrate lyase alpha chain (acyl lyase subunit) (citF) (*Klebsiella pneumonise*) | 72.1 | 86.1 | 469 |
| HI0023 | 26068 | 25457 | citrate lyase beta chain (acyl lyase subunit) (*Klebsiella pneumonise*) | 62.3 | 81.9 | 203 |
| HI0024 | 26352 | 25088 | citrate lyase gamma chain (acyl lyase subunit) (citD) (*Klebsiella pneumonise*) | 52.1 | 71.9 | 97 |
| HI1667 | 1728793 | 1727567 | dihydroliposmide succinyltransferase (sucB) (*Escherichia coli*) | 73.6 | 84.5 | 403 |
| HI1403 | 1493925 | 1495316 | fumarate hydratase class II (fumarase) (fumC) (*Escherichia coli*) | 81.8 | 74.2 | 460 |
| HI1215 | 1275907 | 1276839 | malate dehydrogenase (mdh) (*Escherichia coli*) | 78.5 | 85.1 | 303 |
| HI1248 | 1317431 | 1319690 | malic acid enzyme (*Bacillus stearothermophilus*) | 49.5 | 68.3 | 376 |
| HI1200 | 1262687 | 1263585 | succinyl-CoA synthetase alpha-subunit (sucD) (*Escherichia coli*) | 83.4 | 91.7 | 289 |
| HI1199 | 1261518 | 1262684 | succinyl-CoA synthetase beta-subunit (sucC) (*Escherichia coli*) | 64.7 | 80.2 | 388 |
| Pentose phosphate pathway | | | | | | |
| HI0556 | 574158 | 572708 | 6-phosphogluconate dehydrogenase, decarboxylating (gnd) (*Escherichia coli*) | 54.0 | 71.1 | 464 |
| HI0560 | 577777 | 576296 | glucose-6-phosphate 1-dehydrogenase (G6PD) (*Synechococous sp.*) | 46.2 | 65.3 | 483 |
| HI1025 | 1088660 | 1086566 | transluetolese 1 (TK 1) (tktA) (*Escherichia coli*) | 77.1 | 87.5 | 664 |
| Entner-Doudoroff | | | | | | |
| HI0047 | 45381 | 47745 | 2-keto-3-deoxy-6-phosphogluconate aldolase (eda) (*Escherichia coli*) | 37.3 | 63.2 | 193 |
| HI0049 | 50201 | 49260 | 2-keto-3-deoxy-D-gluconate lanase (kdgK) (*Eninnis chrysanthemi*) | 44.2 | 64.5 | 300 |
| Aerobic | | | | | | |
| HI1655 | 1715678 | 1713987 | D-lactate dehydrogenase (dld) (*Escherichia coli*) | 59.5 | 77.7 | 560 |
| HI1166 | 1234330 | 1231250 | D-lactate dehydrogenase (dld) (*Saccharomyces cerevisiae*) | 27.6 | 47.7 | 427 |
| HI0607 | 635168 | 636172 | glycerol-3-phosphate dehydrogenase (gpsA) (*Escherichia coli*) | 66.6 | 81.5 | 335 |
| HI0749 | 805382 | 806713 | NADH dehydrogenase (ndh) (*Escherichia coli*) | 57.8 | 75.4 | 430 |
| Anaerobic | | | | | | |
| HI1049 | 1112944 | 1110527 | anaerobic dimethyl sulfoxide reductase A (dmsA) (*Escherichia coli*) | 74.0 | 86.3 | 785 |
| HI1048 | 1110513 | 1109899 | anaerobic dimethyl sulfoxide reductase B (dmsB) (*Escherichia coli*) | 72.1 | 84.8 | 204 |
| HI1047 | 1109894 | 1109058 | anaerobic dimethyl sulfoxide reductase C (dmsC) (*Escherichia coli*) | 41.0 | 65.0 | 287 |
| HI0648 | 688485 | 687382 | cytochrome C-type protein (torC) (*Escherichia coli*) | 37.4 | 54.7 | 365 |
| HI0350 | 374535 | 375134 | denitrification system component (nirT) (*Pseudomones stutzen*) | 51.7 | 71.6 | 176 |
| HI0009 | 9878 | 10783 | ldhE protein (ldhE) (*Escherichia coli*) | 50.8 | 71.6 | 307 |
| HI0006 | 5067 | 8158 | lormate dehydrogenase, nitrate-inducible major subunit (fdnG) (*Escherichia coli*) | 64.4 | 79.2 | 1015 |
| HI0005 | 4802 | 3993 | formate dehydrogenase-N affector (fdhD) (*Escherichia coli*) | 57.7 | 71.0 | 249 |
| HI0008 | 9035 | 9805 | formate dehydrogenase-O gamma subunit (fdoI) (*Escherichia coli*) | 52.8 | 72.1 | 195 |
| HI0007 | 8161 | 9096 | formate dehydrogenase-O beta subunit (fdoH) (*Escherichia coli*) | 72.2 | 85.6 | 297 |
| HI1071 | 1133439 | 1131826 | formate-dependent nitrite reductase (cytochrome C552) (nrfC) (*Escherichia coli*) | 56.7 | 75.3 | 450 |
| HI1070 | 1131779 | 1131102 | formate-dependent nitrite reductase (nrfB) (*Escherichia coli*) | 50.0 | 66.9 | 134 |
| HI1069 | 1131102 | 1130428 | formate-dependent nitrite reductase protein Fe—S centers (nrfC) (*Escherichia coli*) | 64.2 | 81.2 | 217 |
| HI1068 | 1130428 | 1129466 | formate-dependent nitrite reductase transmembrane protein (nrfD) (*Escherichia coli*) | 48.2 | 68.4 | 312 |
| HI0835 | 882094 | 882529 | fumerate reductase (frdC) (*Escherichia coli*) | 49.2 | 72.3 | 129 |
| HI0834 | 882093 | 881752 | fumerate reductase 13 kDa hydrophobic protein (frdD) (*Escherichia coli*) | 53.0 | 76.5 | 119 |
| HI0837 | 885089 | 883293 | fumarate reductase, flavoprotein subunit (frdA) (*Escherichia coli*) | 75.4 | 87.2 | 602 |
| HI0636 | 883357 | 882530 | fumarate reductase, iron-sulfur protein (frdB) (*Escherichia coli*) | 75.5 | 85.3 | 244 |
| HI0681 | 720855 | 720541 | glpE protein (glpE) (*Escherichia coli*) | 43.3 | 63.5 | 103 |
| HI0620 | 651184 | 651759 | glpG protein (glpG) (*Escherichia coli*) | 39.1 | 64.8 | 178 |
| HI0687 | 729160 | 727492 | glycerol-3-phosphate dehydrogenase, subunit A (glpA) (*Escherichia coli*) | 69.9 | 52.7 | 531 |
| HI0686 | 727529 | 726204 | glycerol-3-phosphate dehydrogenase, subunit B (glpB) (*Escherichia coli*) | 42.3 | 60.3 | 414 |
| HI0685 | 726189 | 724912 | glycerol-3-phosphate dehydrogenase, subunit C (glpC) (*Escherichia coli*) | 58.8 | 76.0 | 393 |

-continued

| | | | | | | |
|---|---|---|---|---|---|---|
| HI1395 | 1487087 | 4187358 | hydrogenase isoenzymes formation protein (hypC) (*Escherichia coli*) | 53.2 | 81.6 | 76 |

Electron transport

| | | | | | | |
|---|---|---|---|---|---|---|
| HI0887 | 936816 | 938552 | C-type cytochrome biogenesis protein (copper tolerance) (cycZ) (*Escherichia coli*) | 48.8 | 57.7 | 557 |
| HI1078 | 1141318 | 1139756 | cytochrome oxidase d subunit I (cydA) (*Escherichia coli*) | 84.3 | 82.4 | 515 |
| HI1077 | 1139738 | 1138605 | cytochrome oxidase d subunit II (cydB) (*Escherichia coli*) | 60.9 | 78.4 | 379 |
| HI0629 | 549672 | 550341 | ferrodoxin )fdx) (*Chromatium vinosum*) | 59.5 | 77.2 | 78 |
| HI0374 | 394564 | 394226 | ferrodoxin (fdx) (*Escherichia coli*) | 64.5 | 83.6 | 110 |
| HI0192 | 205148 | 204627 | Flavodixin (fldA (*Escherichia coli*) | 76.9 | 87.3 | 173 |
| HI1365 | 1446272 | 1447807 | AND(P) transhydrogenas subunit alpha (pntA) (*Escherichia coli*) | 73.7 | 84.1 | 509 |
| HI1366 | 1447821 | 1449242 | AND(P) transhydrogenase subunit beta (pntB) (*Escherichia coli*) | 80.5 | 87.7 | 462 |
| HI1281 | 1355273 | 1354614 | AND(P)H-flavin oxidorductase (*Vibrio fischeri*) | 33.3 | 54.8 | 211 |

Fermentation

| | | | | | | |
|---|---|---|---|---|---|---|
| HI0601 | 514365 | 515657 | aldehyde dehydrogenase (aklH) (*Escherichia coli*) | 41.2 | 61.8 | 236 |
| HI0776 | 836764 | 836114 | butyrate-acetoacetate cos-transferase subunit A (ctlA) (*Clostridium acetobutylicum*) | 53.3 | 75.2 | 214 |
| HI0186 | 200017 | 198884 | glutathione-dependent formaldehyde dehydrogenase )gd-laidH) (*Paracoccus denitrificans*) | 58.5 | 77.6 | 375 |
| HI1308 | 1383529 | 1384583 | hydrogenase gene region (hypE) (*Alcaligenes eutrophus*) | 28.1 | 48.2 | 237 |
| HI1642 | 1698196 | 1700833 | phosphoenolpytuvate carboxylase (ppc) (*Escherichia coli*) | 64.8 | 80.0 | 983 |
| HI0181 | 193936 | 191621 | pyruvate formate-lyase (pfl) (*Escherichia coli*) | 86.1 | 82.9 | 760 |
| HI0180 | 191487 | 190750 | pyruvate formate-lyase activating enzyme (act) (*Escherichia coli*) | 74.0 | 85.4 | 246 |
| HI1435 | 1517826 | 1518581 | short chain alcohol dehydrogenase (ORFB) (*Dichelobacter nodoeus*) | 51.9 | 69.2 | 104 |

Gluconeogenesis

| | | | | | | |
|---|---|---|---|---|---|---|
| HI1651 | 1709919 | 1710917 | fructose-1-6-bisphosphatase (fbp) (*Escherichia coli*) | 70.5 | 84.0 | 331 |
| HI0811 | 859038 | 857425 | phosphoenolpyruvate carboxylinase (pckA) (*Escherichia coli*) | 71.7 | 83.0 | 444 |

ATP-proton motive force interconversion

| | | | | | | |
|---|---|---|---|---|---|---|
| HI0466 | 504824 | 504573 | ATP synthease C chain (atpE) (*Vibrio alginolyticus*) | 62.7 | 81.9 | 83 |
| HI0467 | 505668 | 504883 | ATP synthase F0 subunit a (stpB) (*Escherichia coli*) | 58.2 | 78.1 | 261 |
| HI0485 | 504520 | 504053 | ATP synthase F0 subunit b (stpF) (*Escherichia coli*) | 63.5 | 79.5 | 156 |
| HI0483 | 503491 | 501953 | ATP synthase F1 subunit (stpA) (*Escherichia coli*) | 86.5 | 94.7 | 513 |
| HI0481 | 501081 | 499678 | ATP synthase F1 beta subunit (atpD) (*Escherichia coli*) | 89.3 | 96.1 | 460 |
| HI0484 | 504037 | 503507 | ATP synthase F1 delta subunit (atpH) (*Escherichia coli*) | 58.0 | 78.4 | 176 |
| HI0480 | 499645 | 499220 | ATP synthase F1 ipsilon subunit (atpC) (*Escherichia coli*) | 59.6 | 75.7 | 136 |
| HI0482 | 501934 | 501068 | ATP synthase F1 gamma subunit (stpG) (*Escherichia coli*) | 65.3 | 83.0 | 287 |
| HI1277 | 1349508 | 1350221 | ATP synthase subunit 3 region protein (atp) (*Rhodpseudomonas blastics*) | 31.9 | 50.0 | 237 |

Fatty acid/phospholipid metabolism

| | | | | | | |
|---|---|---|---|---|---|---|
| HI0773 | 834230 | 832896 | acetyl coenzyme A acetyltransferase (thiolase) (fadA) (*Clostndium acetobuylicum*) | 63.0 | 80.4 | 391 |
| HI0428 | 448891 | 448169 | fdR protein involved in fatty acid metabolism (fadR) (*Escherichia coli*) | 47.4 | 68.4 | 234 |
| HI1064 | 1126738 | 1126295 | (3R)-hydroxymynatol acyl carner protein dehydrase )fabZ) (*Escherichia coli*) | 68.1 | 85.1 | 141 |
| HI0156 | 171552 | 170827 | 3-ketoacyl-acyl carner protein reductase (fabG) (*Escherichia coli*) | 73.4 | 88.4 | 241 |
| HI0408 | 427385 | 426441 | acetyl-CoA carboxylase (accA) (*Escherichia coli*) | 75.8 | 88.3 | 318 |
| HI0155 | 170568 | 170341 | acyl carrier protein (acpP) (*Escherichia coli*) | 82.7 | 90.7 | 75 |
| HI0076 | 82175 | 83032 | acyl-CoA thioesterase II (tesB) (*Escherichia coli*) | 52.3 | 73.1 | 283 |
| HI1539 | 1605754 | 1604537 | beta-katoacyl-ACP synthase I (labB) (*Escherichia coli*) | 72.8 | 83.7 | 403 |
| HI0158 | 174085 | 173138 | beta-katoacyl-acyl carrier protein synthase III (labH) (*Escherichia coli*) | 65.9 | 79.8 | 317 |
| HI0973 | 1027538 | 1028002 | biotin carboxyl carrier protein (accB) (*Escherichia coli*) | 71.2 | 82.7 | 156 |
| HI0974 | 1028180 | 1029523 | biotin carboxylase (accC) (*Escherichia coli*) | 81.5 | 91.3 | 448 |
| HI1328 | 1404041 | 1404571 | D-3-hydroxydecanoyl-(acyl carrier-protein) dehydratase (labA) (*Escherichia coli*) | 79.2 | 91.7 | 168 |
| HI0337 | 362881 | 363234 | diacylglycerol kinase (dgkA) (*Escherichia coli*) | 50.9 | 71.8 | 110 |
| HI0002 | 601 | 2421 | long chain fatty acid coA ligase (*Homo sapiens*) | 29.5 | 52.8 | 575 |
| HI0157 | 172507 | 171572 | maionyl coenzyme A-acyl carrier protein transacylase (labO) (*Escherichia coli*) | 71.0 | 81.6 | 308 |
| HI1740 | 1811556 | 1810672 | short chain alcohol dehydrogenase homolog (envM) (*Escherichia coli*) | 75.3 | 84.9 | 259 |
| HI1438 | 1521691 | 1520741 | USG-1 protein (usg) (*Escherichia coli*) | 32.7 | 53.9 | 334 |
| HI0738 | 788371 | 787652 | 1-acyl-glycerol-3-phosphate acyltransferase (pisC) (*Escherichia coli*) | 62.2 | 78.2 | 238 |
| HI0921 | 975561 | 974698 | CDP-diglyceride synthetase (cdsA) (*Escherichia coli*) | 48.4 | 66.5 | 248 |
| HI0750 | 809228 | 806799 | glycerol-3-phosphate acyltransferase (plaB) (*Escherichia coli*) | 57.3 | 75.7 | 804 |
| HI0212 | 225946 | 225224 | phosphatidylglycerophosphate phosphatase B (pgpB) (*Escherichia coli*) | 35.7 | 60.3 | 220 |
| HI0123 | 138207 | 138761 | phosphatidylglycerophosphate synthase (pgsA) (*Escherichia coli*) | 66.5 | 83.0 | 182 |
| HI0161 | 175145 | 176014 | phosphatidylsenne decarboxylase proenzyme (ped) (*Escherichia coli*) | 57.6 | 75.5 | 280 |
| HI0427 | 446754 | 448118 | phosphatidylsenne synthase (pssA) (*Escherichia coli*) | 49.2 | 70.8 | 452 |
| HI0691 | 732349 | 733440 | protein D (hpd) (*Haemophilus influenzae*) | 98.4 | 99.2 | 364 |

Purines, pynmidines, nucleosides and nucleotides

Punne ribonucleotide biosynthesis

| | | | | | | |
|---|---|---|---|---|---|---|
| HI1522 | 1582920 | 1684005 | 5'-phosphonbosyl-5-amino-4-imidazole carboxylase II (purK) (*Escherichia coli*) | 56.8 | 71.9 | 351 |
| HI1434 | 1517646 | 1516615 | 5'-phosphonbosyl-5-aminoimidazole synthetase (purM) (*Escherichia coli*) | 76.5 | 86.7 | 344 |
| HI1749 | 1829283 | 1828660 | 5'guanylate kinase (gmk) (*Escherichia coli*) | 64.7 | 81.6 | 206 |

-continued

| | | | | | | |
|---|---|---|---|---|---|---|
| HI0351 | 375941 | 375300 | adeynlate kinase (ATP-AMP transphosphorylase) (adk) (*Haemophilus influenzae*) | 99.5 | 99.5 | 214 |
| HI0641 | 579574 | 581094 | adenylosuccinate lyase (purB) (*Escherichia coli*) | 76.5 | 87.9 | 456 |
| HI1639 | 1694462 | 1695757 | adenylosuccinate synthetase (purA) (*Escherichia coli*) | 75.7 | 87.3 | 432 |
| HI1210 | 1272783 | 1274297 | amidophosphonbosyltransferase (purF) (*Escherichia coli*) | 69.1 | 84.0 | 504 |
| HI0754 | 812369 | 816326 | formylglycineamide ribonucleotide synthetase (purL) (*Escherichia coli*) | 59.7 | 82.0 | 1290 |
| HI1594 | 1655627 | 1658480 | formylietishydrololate hydrolase (purU) (*Escherichia coli*) | 72.6 | 85.2 | 277 |
| HI0223 | 250532 | 252100 | guaA protein (guaA) (*Escherichia coli*) | 75.1 | 57.6 | 525 |
| HI0222 | 248355 | 249818 | inosine-5'-monophosphate dehydrogenase (guaB) (*Acinetobacter calcoaceocus*) | 62.7 | 80.9 | 487 |
| HI0878 | 928811 | 929233 | nucleoside diphosphale kinase (ndk) (*Escherichia coli*) | 63.0 | 73.9 | 138 |
| HI0890 | 940953 | 942239 | phosphonbosylamino-glycine ligase (purD) (*Escherichia coli*) | 75.2 | 84.5 | 427 |
| HI1621 | 1582355 | 1682847 | phosphonbosylimidazole carboxylase catalytic subunit (purE) (*Haemophilu influenzae*) | 94.4 | 96.9 | 161 |
| HI0889 | 939259 | 940854 | phosphonbosylaminoimidazolecarboxamide formyltransferase (purH) (*Escherichia coli*) | 77.2 | 86.5 | 525 |
| HI1433 | 1516567 | 1515922 | phosphonbosylglycinamide formyltransferase (purN) (*Escherichia coli*) | 51.9 | 71.4 | 210 |
| HI1615 | 1674317 | 1675261 | phosphonbosylpyrophosphate synthetase (prsA) (*Salmonella typhimurium*) | 84.1 | 91.1 | 314 |
| HI1732 | 1798036 | 1798953 | SAICAR synthetase (purC) (*Streptococcus pneumonae*) | 29.5 | 54.8 | 204 |
| Pyrimidine ribonucleotide biosyn | | | | | | |
| HI1406 | 1497997 | 1496981 | dihydroorotate dehydrogenase (dihydroorotate oxidase) (pyrD) (*Escherichia coli*) | 80.7 | 77.4 | 334 |
| HI0274 | 305799 | 305161 | orotate phosphonbosyltransferase (pyrE) (*Escherichia coli*) | 69.0 | 83.8 | 213 |
| HI1228 | 1293955 | 1294282 | pyrF opeion encoding orobdine 5'-monophosphate (OMP) decarboxylase (*Escherichia coli*) | 77.1 | 87.6 | 105 |
| HI1227 | 1293266 | 1293955 | pyrF protein (pyrF) (*Escherichia coli*) | 62.3 | 79.4 | 228 |
| HI0461 | 480053 | 479517 | uracil phosphonbosyltransferase (pyrR) (*Bacillus caldolyticus*) | 52.2 | 73.9 | 179 |
| 2'-deoxyribonucleotide metabolism | | | | | | |
| HI0075 | 79934 | 82054 | anaerobic ribonucleoside-triphosphate reductase (nrdD) (*Escherichia coli*) | 77.4 | 88.2 | 702 |
| HI0133 | 146656 | 147240 | deoxycyladine triphosphate deaminase (dcd) (*Escherichia coli*) | 75.6 | 86.5 | 193 |
| HI0956 | 1012787 | 1013239 | deoxyundinetriphosphatase (dut) (*Escherichia coli*) | 75.5 | 90.7 | 151 |
| HI1838 | 1604204 | 1604464 | glutaredoxin (grx) (*Escherichia coli*) | 69.9 | 79.5 | 83 |
| HI1666 | 1726318 | 1727448 | nrdB protein (nrdB) (*Escherichia coli*) | 85.4 | 82.6 | 376 |
| HI1665 | 1723831 | 1726173 | ribonucleoside-diphosphate reductase 1 alpha chain (nrdA) (*Escherichia coli*) | 83.4 | 92.2 | 761 |
| HI1161 | 1227925 | 1226972 | thioradoxin reductase (trxB) (*Escherichia coli*) | 75.9 | 85.8 | 316 |
| HI0907 | 958914 | 959762 | thymidylate synthetase (thyA) (*Escherichia coli*) | 35.3 | 55.0 | 254 |
| Salvage of nucleosides and nucleotides | | | | | | |
| HI0585 | 805064 | 803094 | 2',3'-cyclic-nucleotide 2'-phosphodiesterase (cpdB) (*Escherichia coli*) | 62.4 | 77.7 | 641 |
| HI1233 | 1299794 | 1299255 | adeninephosphoribosyltransferase (apt) (*Escherichia coli*) | 66.1 | 83.1 | 177 |
| HI0653 | 571120 | 571943 | adenosine-tetrephosphatase (apsH) (*Escherichia coli*) | 52.4 | 73.1 | 271 |
| HI1353 | 1426390 | 1427265 | cytidine deaminase (cytidine aminohydroises) (cds) (*Escherichia coli*) | 50.0 | 63.4 | 253 |
| HI1222 | 1258579 | 1289628 | cytidylate kinase (cmk) (*Escherichia coli*) | 64.5 | 79.3 | 217 |
| HI1652 | 1711636 | 1710842 | cytidylate kinase (cmk) (*Escherichia coli*) | 63.5 | 76.6 | 202 |
| HI0620 | 540879 | 540188 | purine-nucleoside phosphorylase (deoD) (*Escherichia coli*) | 84.3 | 90.2 | 235 |
| HI0631 | 552177 | 551599 | thymidine kinase (tdk) (*Escherichia coli*) | 68.6 | 82.4 | 188 |
| HI1231 | 1297060 | 1296427 | uracil phosphonbosyltransferase (upp) (*Escherichia coli*) | 83.2 | 93.6 | 208 |
| HI0676 | 716559 | 718095 | xanthine guanine phosphoribosyl transferase gpt (xgprt) (*Escherichia coli*) | 72.1 | 87.7 | 152 |
| HI0694 | 736541 | 736077 | xanthine-guanine phosphonbosyltransferase (xprt) (*Salmonells typhimurium*) | 74.0 | 67.7 | 152 |
| HI1280 | 1353404 | 1354561 | putative ATOase (mrp) (*Escherichia coli*) | 66.0 | 79.0 | 353 |
| Sugar-nucleotide biosynthesis, conversions | | | | | | |
| HI0207 | 219511 | 221319 | 5'-nucleotidase (ushA0 *Homo sapiens*) | 34.5 | 54.8 | 487 |
| HI1282 | 1355378 | 1358061 | CMP-NeuNAc synthetase (sisB) (*Neisseris meningtidis*) | 47.1 | 64.3 | 221 |
| HI0822 | 871597 | 870551 | galactose-1-phosphate undylyltransferase (galT) (*Haemophilus influenzae*) | 99.1 | 100.0 | 349 |
| HI0814 | 862832 | 861748 | glucosephosphate undylyltransferase (galU) (*Escherichia coli*) | 74.0 | 86.1 | 287 |
| HI0353 | 378461 | 377448 | udp-glucose 4-epimerase (galactowaldenase) (galE) (*Haemophilus influenzae*) | 99.1 | 99.1 | 338 |
| HI0644 | 662446 | 683813 | UDP-N-acetylglucocamine pyrophosphorylase (glmU) (*Escherichia coli*) | 68.6 | 83.1 | 456 |
| Nucleotide and nucleoside interconversions | | | | | | |
| HI1302 | 1376759 | 1378139 | deoxyguanosine triphosphate triphosphohydrolase (dgt) (*Escherichia coli*) | 38.2 | 57.6 | 469 |
| HI1079 | 1141970 | 1143603 | pyrG protein (pyrG) (*Escherichia coli*) | 80.4 | 90.5 | 545 |
| HI0132 | 148006 | 146644 | uridine kinase (undine monophokinase) (udk) (*Escherichia coli*) | 67.8 | 84.7 | 202 |
| Regulatory functions | | | | | | |
| HI0806 | 632583 | 635094 | adenylate cyclase (cysA) (*Haemophilus influenzae*) | 100.0 | 100.0 | 843 |
| HI0886 | 936824 | 935917 | aerobic respiration control protein ARCA (DYE resistance protein) (arcA) (*Escherichia coli*) | 77.2 | 87.8 | 237 |
| HI0221 | 238723 | 248354 | aerobic respiration control sensor protein (arcB) (*Escherichia coli*) | 45.7 | 70.4 | 768 |
| HI1054 | 1117672 | 1116979 | araC-like transcription regulator (*Streptomyces lividans*) | 25.7 | 47.7 | 303 |
| HI1212 | 1275700 | 1275246 | arginine repressor protein (argR) (*Escherichia coli*) | 69.1 | 81.2 | 149 |
| HI0237 | 265657 | 265310 | arsC protein (arsC) (Plasmid R773) | 38.3 | 56.5 | 114 |
| HI0454 | 482094 | 484602 | ATP-dependent proteinase (lon) (*Escherichia coli*) | 74.5 | 87.9 | 769 |
| HI0336 | 360836 | 362863 | ATP:GTP 3'-pyrophosphotransferase (relA) (*Escherichia coli*) | 62.9 | 80.5 | 741 |
| HI1130 | 1193658 | 1195126 | carbon starvation protein (cstA) (*Escherichia coli*) | 32.1 | 53.5 | 499 |

-continued

| | | | | | | |
|---|---|---|---|---|---|---|
| HI0815 | 862845 | 862657 | carbon storage regulator (cstA) (*Escherichia coli*) | 68.4 | 91.2 | 57 |
| HI0906 | 863619 | 853063 | cyclic AMP receptor protein (crp) (*Haemophilus influenzae*) | 27.2 | 46.7 | 174 |
| HI0959 | 1014161 | 1014832 | cyclic AMP receptor protein (crp) (*Haemophilus influenzae*) | 100.0 | 100.0 | 224 |
| HI1203 | 1265444 | 1266412 | cys regulon transcriptional activator (cysB) (*Escherichia coli*) | 63.3 | 79.3 | 324 |
| HI0191 | 204595 | 204158 | ferric uptake regulation protein (fur) (*Escherichia coli*) | 61.4 | 75.0 | 139 |
| HI1457 | 1537858 | 1537391 | limbrial transcription regulation repressor (pilB) (*Neiasoria gonorrhoaes*) | 32.3 | 53.2 | 124 |
| HI1459 | 1539614 | 1538556 | limbrial transcription regulation repressor (pilB) (*Neiasoria gonorrhoaes*) | 59.0 | 72.6 | 325 |
| HI1263 | 1336881 | 1337548 | folyipolyglutamate-dihydrofolate synthetase expression regulator (accD) (*Escherichia coli*) | 69.5 | 62.5 | 290 |
| HI1430 | 1512975 | 1513745 | fumerate (and nitrate) reduction regulatory protein (fnr) (*Escherichia coli*) | 78.8 | 88.8 | 240 |
| HI0823 | 871805 | 872800 | galactose operon repressor (galS) (*Haemophilus influenzae*) | 99.1 | 99.4 | 332 |
| HI0756 | 817661 | 818559 | glucolonase regulator (*Rattus norvegicus*) | 31.8 | 56.1 | 512 |
| HI0621 | 651792 | 652556 | glycerol-3-phosphate regulon repressor (glpR) (*Escherichia coli*) | 61.5 | 77.4 | 252 |
| HI1011 | 1073676 | 1073047 | glycerol-3-phosphate regulon repressor (glpR) (*Escherichia coli*) | 28.6 | 50.3 | 198 |
| HI1197 | 1259493 | 1260395 | glcine cleavage system transcriptional activator (gcvA) (*Escherichia coli*) | 51.7 | 69.1 | 298 |
| HI0013 | 13742 | 12837 | GTP-binding protein (era) (*Escherichia coli*) | 77.9 | 87.0 | 299 |
| HI0879 | 930478 | 929309 | GTP-binding protein (obg) (*Bacillus subtilis*) | 47.7 | 70.9 | 332 |
| HI0673 | 592001 | 591099 | hydrogen percade-inducible activator (oxyR) (*Escherichia coli*) | 71.1 | 85.9 | 298 |
| HI0617 | 647526 | 646780 | L-lucose operon activator (leoR) (*Escherichia coli*) | 35.1 | 56.1 | 229 |
| HI0401 | 420131 | 420952 | lacZ exression regulator (ioc) (*Escherichia coli*) | 52.9 | 71.3 | 261 |
| HI0225 | 253133 | 253638 | leucine responsive regulatory protein (lrp) (*Escherichia coli*) | 29.6 | 52.8 | 152 |
| HI1602 | 1663150 | 1862653 | leucine responsive regulatory protein (lrp) (*Escherichia coli*) | 77.2 | 86.7 | 155 |
| HI0751 | 809477 | 810103 | LEXA repressor (lexA) (*Escherichia coli*) | 66.1 | 85.3 | 202 |
| HI1465 | 1542848 | 1542810 | lipooligosaccharide protein (lex2A) (*Haemophilus influenzae*) | 44.4 | 66.7 | 9 |
| HI1466 | 1542849 | 1543428 | lipooligosaccharide protein (lex2A) (*Haemophilus influenzae*) | 50.0 | 66.7 | 48 |
| HI0296 | 328190 | 327878 | metF aporepressor (metJ) (*Escherichia coli*) | 81.9 | 93.3 | 105 |
| HI1478 | 1558154 | 1557312 | molybdenum transport system alternative nitrogenae regulator (modD) (*Rhodobacter capsulatus*) | 31.8 | 51.7 | 259 |
| HI0200 | 214274 | 215227 | msbB protein (msbB) (*Escherichia coli*) | 45.3 | 67.0 | 301 |
| HI0411 | 429238 | 430662 | msbB protein (msbB) (*Escherichia coli*) | 50.9 | 69.3 | 284 |
| HI0712 | 756824 | 757117 | negative regulator of translation (retB) (*Escherichia coli*) | 28.3 | 48.3 | 60 |
| HI0631 | 667822 | 668406 | negative rpo regulator(mclA) (*Escherichia coli*) | 40.1 | 62.9 | 199 |
| HI0269 | 299532 | 301232 | nitrate sensor protein (narO) (*Escherichia coli*) | 38.6 | 63.0 | 555 |
| HI0728 | 778003 | 777380 | nitrate/nitrite response regulator protein (narP) (*Escherichia coli*) | 59.6 | 79.3 | 205 |
| HI0339 | 363915 | 364250 | nitrogen regulatory protein P-H (glnB) (*Escherichia coli*) | 77.7 | 93.8 | 112 |
| HI1747 | 1828067 | 1826037 | penta-phosphate guanosine-J pyrophosphohydrolase (spoT) (*Escherichia coli*) | 58.8 | 76.8 | 675 |
| HI0200 | 214274 | 215227 | phosphate regulon sensor protein (phoR) (*Escherichia coli*) | 41.8 | 66.8 | 335 |
| HI1382 | 1475709 | 1475017 | phosphate regulon transcriptional regulatory protein (phoB) (*Escherichia coli*) | 52.9 | 71.8 | 227 |
| HI0765 | 827030 | 825768 | probably nadAB transcriptional regulator (nedR) (*Escherichia coli*) | 54.6 | 75.1 | 349 |
| HI1641 | 1697003 | 1698115 | punne necletide synthesis repressor protein (purR) (*Escherichia coli*) | 55.9 | 74.5 | 326 |
| HI0164 | 178405 | 178713 | putativo murein geno regulator (bolA) (*Escherichia coli*) | 47.1 | 65.7 | 102 |
| HI0508 | 522278 | 523273 | rbs repressor (rbsR) (*Escherichia coli*) | 48.8 | 71.0 | 329 |
| HI0565 | 582225 | 581776 | regulatory protein (asnC) (*Escherichia coli*) | 68.0 | 81.0 | 147 |
| HI1617 | 1677452 | 1676583 | regulatory protein sfs1 involved in meltose metabolism (srsA) (*Escherichia coli*) | 54.3 | 71.2 | 218 |
| HI0995 | 946128 | 946688 | repressor for sytochrome P450 (Bm3R1) (*Bacillus magatenum*) | 23.3 | 50.5 | 182 |
| HI0271 | 302396 | 303238 | RNA polymerase sigma-32 factor (heat shock regulatory protein F334) (rpoH) (*Escherichia coli*) | 70.8 | 86.8 | 281 |
| HI0535 | 555646 | 557532 | RNA polymerase sigma-70 factor (rpoD) (*Escherichia coli*) | 68.9 | 80.8 | 608 |
| HI0630 | 667228 | 667794 | RNA polymerase sigma-E factor (rpoE) (*Escherichia coli*) | 73.0 | 87.8 | 189 |
| HI1713 | 1781137 | 1779785 | sensor protein for basR (basS) (*Escherichia coli*) | 30.0 | 55.7 | 253 |
| HI1444 | 1529117 | 1528668 | stringent starvation protein (sspB) (*Escherichia coli*) | 63.2 | 81.1 | 106 |
| HI1445 | 1529755 | 1529120 | stringent starvation protein A (sspA) (*Haemophilus somnus*) | 76.9 | 87.3 | 212 |
| HI1745 | 1815630 | 1814704 | trans-activator of metE and metH (metR) (*Escherichia coli*) | 39.5 | 60.8 | 294 |
| HI0360 | 382477 | 383121 | transcription activator (tenA) (*Bacillus subtilis*) | 27.8 | 48.3 | 208 |
| HI0883 | 722643 | 721766 | transcriptional activator protein (xlvY) (*Escherichia coli*) | 47.4 | 70.3 | 293 |
| HI1714 | 1781799 | 1781137 | transcriptional regulatory protein (basR) (*Escherichia coli*) | 43.5 | 59.7 | 216 |
| HI0412 | 430780 | 431783 | transcriptional regulatory protein (tyrR) (*Escherichia coli*) | 48.2 | 65.8 | 306 |
| HI0832 | 880611 | 880913 | tryptophan repressor (trpR) (*Emerobacter aerogenea*) | 38.8 | 67.0 | 88 |
| HI0054 | 54188 | 54965 | uxu operon regulator (uxuR) (*Escherichia coli*) | 50.0 | 72.1 | 246 |
| HI1109 | 1170415 | 1169255 | xylose operon regulatory protein (xylR) (*Escherichia coli*) | 57.3 | 75.3 | 384 |

Replication

DNA - replication, realr/modification, recombination

| | | | | | | |
|---|---|---|---|---|---|---|
| HI0751 | 822003 | 823136 | A/G-specific adenine glycosylase (mulY) (*Escherichia coli*) | 81.9 | 75.1 | 341 |
| HI0895 | 1056874 | 1055313 | chromosomal replication initiator protein (dnaA) (*Escherichia coli*) | 61.7 | 79.7 | 464 |
| HI1229 | 1294415 | 1294317 | chromosomal replication initiator protein (dnaA) (*Escherichia coli*) | 50.0 | 75.0 | 12 |
| HI0316 | 345720 | 345151 | crossover junction endodioxyribonuclease (ruvC) (*Escherichia coli*) | 78.5 | 88.3 | 163 |
| HI0955 | 1011537 | 1012736 | dtp protein (dtp) (*Escherichia coli*) | 61.1 | 76.8 | 402 |
| HI0210 | 223259 | 224116 | DNA adenine methylase (dam) (*Escherichia coli*) | 55.4 | 71.4 | 268 |
| HI1267 | 1343755 | 1341116 | DNA gyrase, subunit A (gyrA) (*Escherichia coli*) | 70.6 | 84.8 | 859 |
| HI0569 | 587397 | 584980 | DNA gyrase, subunit B (gyrB) (*Escherichia coli*) | 74.7 | 85.9 | 803 |
| HI1191 | 1255302 | 1253122 | DNA helicase II (uvrD) (*Haemophilus influenzae*) | 96.8 | 97.5 | 727 |
| HI1102 | 1162989 | 1160953 | DNA ligase (lig) (*Escherichia coli*) | 63.7 | 79.9 | 666 |
| HI0405 | 423539 | 424207 | DNA mismatch protein (mutH) (*Escherichia coli*) | 60.4 | 80.7 | 212 |
| HI0709 | 750565 | 753147 | DNA mismatch repair protein (mutS) (*Escherichia coli*) | 71.0 | 84.0 | 853 |

-continued

| | | | | | | |
|---|---|---|---|---|---|---|
| HI0067 | 69622 | 71508 | DNA mismatch repair protein MUTL (mutL) (*Escherichia coli*) | 50.2 | 67.3 | 612 |
| HI0858 | 904919 | 902130 | DNA polymerase I (polA) (*Escherichia coli*) | 63.1 | 77.0 | 928 |
| HI0994 | 1055297 | 1054200 | DNA polymerase III beta-subunit (dnaN) (*Escherichia coli*) | 62.6 | 80.3 | 366 |
| HI0457 | 476761 | 475763 | DNA polymerase III delta prime subunit (holB) (*Escherichia coli*) | 35.3 | 57.4 | 316 |
| HI0925 | 979730 | 980761 | DNA polymerase III delta subunit (holA) (*Escherichia coli*) | 45.2 | 62.0 | 332 |
| HI0138 | 152669 | 151902 | DNA polymerase III epsilon subunit (dnaO) (*Escherichia coli*) | 61.3 | 76.5 | 236 |
| HI0741 | 799019 | 795544 | DNA polymerase III, alpha chain (dnaE) (*Escherichia coli*) | 71.9 | 85.7 | 1159 |
| HI1402 | 1493690 | 1493259 | DNA polymerase III, chi subunit (holC) (*Haemophilus influenzae*) | 95.9 | 98.9 | 88 |
| HI0011 | 11672 | 11271 | DNA polymerase III, psi subunit (holD) (*Escherichia coli*) | 34.4 | 59.2 | 123 |
| HI0534 | 553659 | 555645 | DNA primase (dnaG) (*Escherichia coli*) | 56.5 | 73.8 | 571 |
| HI1746 | 1826037 | 1823959 | DNA recombinase (recG) (*Escherichia coli*) | 68.5 | 80.1 | 893 |
| HI0070 | 77166 | 75493 | DNA repair protein (recN) (*Escherichia coli*) | 48.6 | 67.3 | 833 |
| HI0659 | 699507 | 700058 | DNA toporsomerase I (topA) (*Bacillus subtilis*) | 34.2 | 55.0 | 110 |
| HI0656 | 698124 | 697570 | DNA-3-methyladenine glycosidase I (lagI) (*Escherichia coli*) | 62.6 | 76.0 | 179 |
| HI0730 | 779457 | 781969 | DNA-dependent ATPase, DNA helicase (recO) (*Escherichia coli*) | 62.9 | 77.6 | 589 |
| HI0568 | 584850 | 584159 | DOD protein (dod) (*Serratia marcascans*) | 81.4 | 93.3 | 210 |
| HI0062 | 65230 | 65664 | dosage-dependent dnaK supressor protein (dksA) (*Escherichia coli*) | 73.9 | 83.8 | 142 |
| HI0948 | 1005798 | 1004986 | lormamidopyrimidine-DNA glycosylase (lpg) (*Escherichia coli*) | 57.8 | 74.7 | 269 |
| HI0584 | 602405 | 600519 | glucose inhibited division protein (gidA) (*Escherichia coli*) | 76.1 | 87.3 | 627 |
| HI0488 | 506816 | 506208 | glucose inhibited division protein (gidB) (*Escherichia coli*) | 64.0 | 78.0 | 200 |
| HI0982 | 1037496 | 1037792 | Hin recombinational enhancer binding protein (Iis) (*Escherichia coli*) | 81.6 | 92.9 | 97 |
| HI0514 | 528338 | 527565 | HineII endonuclease (HineII) (*Haemophilus influenzae*) | 98.4 | 98.4 | 258 |
| HI1397 | 1491189 | 1490263 | HindIII modification methyltransferase (hindIIIM) (*Haemophilus influenzae*) | 99.4 | 99.4 | 309 |
| HI1398 | 1492072 | 1491173 | HindIII restriction endonuclease (hindIIIR) (*Haemophilus influenzae*) | 99.7 | 99.7 | 300 |
| HI0315 | 345085 | 344474 | Holiday junction DNA helicase (ruvA) (*Escherichia coli*) | 58.8 | 79.9 | 203 |
| HI0314 | 344483 | 343459 | Holiday junction DNA helicase (ruvB) (*Escherichia coli*) | 80.9 | 90.0 | 330 |
| HI0678 | 719084 | 718180 | integrase/recombinase protein (xerC) (*Escherichia coli*) | 58.0 | 74.0 | 293 |
| HI1316 | 1391102 | 1391389 | integration host factor alpha-subunit (himA) (*Escherichia coli*) | 63.8 | 83.0 | 94 |
| HI1224 | 1291400 | 1291581 | integration host factor beta-subunit (IHF-beta) (himD) (*Escherichia coli*) | 56.5 | 77.2 | 92 |
| HI0404 | 422970 | 423539 | metylated-DNA--protein-cysteine methyltranferase (dall) (*Bacillus subtilis*) | 40.1 | 61.7 | 163 |
| HI0671 | 713369 | 713806 | mioC protein (mioC) (*Escherichia coli*) | 53.6 | 71.5 | 144 |
| HI1043 | 1104813 | 1105724 | modification methylase HgiDl (MHgiDl) (*Herpelosipnon aurantiscus*) | 56.4 | 70.5 | 297 |
| HI0515 | 529891 | 528338 | modification methylase HincII (hincIIM) (*Haemophilus influenzae*) | 98.2 | 96.6 | 502 |
| HI0912 | 963611 | 964312 | mutator mutT (AT-GC transversion) (*Escherichia coli*) | 48.8 | 72.0 | 125 |
| HI0193 | 206098 | 206688 | negative modulator of initiation of replication (seqA) (*Escherichia coli*) | 53.1 | 71.8 | 177 |
| HI0548 | 568202 | 567879 | primosomal protein n precursor (priB) (*Escherichia coli*) | 57.4 | 75.2 | 101 |
| HI0341 | 367532 | 365343 | primosomal protein replication factor (priA) (*Escherichia coli*) | 52.3 | 70.2 | 729 |
| HI0389 | 406402 | 408321 | probable ATP-dependent helicase (dinG) (*Escherichia coli*) | 32.2 | 51.1 | 860 |
| HI0993 | 1054243 | 1053119 | recF protein (recF) (*Escherichia coli*) | 57.0 | 75.8 | 356 |
| HI0334 | 358532 | 359239 | recO protein (recO) (*Escherichia coli*) | 64.6 | 75.5 | 226 |
| HI0502 | 621957 | 620896 | recombinase (recA) (*Haemophilus influenzae*) | 100.0 | 100.0 | 354 |
| HI0061 | 64971 | 62573 | recombination protein (rec2) (*Haemophilus influenzae*) | 99.9 | 99.9 | 800 |
| HI0445 | 464118 | 464717 | recR protein (recR) (*Escherichia coli*) | 74.9 | 88.4 | 199 |
| HI0601 | 620735 | 620358 | regulatory protein (recX) (*Pseudomones fluorescans*) | 26.6 | 50.4 | 117 |
| HI0651 | 694862 | 692768 | rep helicase (rep) (*Escherichia coli*) | 66.9 | 82.7 | 669 |
| HI1232 | 1299240 | 1297177 | replication protein (dnaX) (*Escherichia coli*) | 52.9 | 69.8 | 643 |
| HI1580 | 1641089 | 1642600 | replicative DNA helicase (dnaB) (*Escherichia coli*) | 68.6 | 82.8 | 482 |
| HI1042 | 1103812 | 1104813 | restriction enzyme (hgiDIR) (*Herpetosiphon gigantsus*) | 44.2 | 83.9 | 350 |
| HI1175 | 1241423 | 1242574 | S-adenosylmethionine synthetase 2 (metX) (*Escherichia coli*) | 82.3 | 91.7 | 383 |
| HI1429 | 1512163 | 1511552 | shufflon-specific DNA recombinase (rci) (*Escherichia coli*) | 31.1 | 55.5 | 259 |
| HI0251 | 281830 | 282333 | single-stranded DNA binding protein (sab) (*Haemophilus influenzae*) | 95.8 | 98.2 | 168 |
| HI1576 | 1639113 | 1638016 | site-specific recombinase (rcd) (*Escherichia coli*) | 36.3 | 57.0 | 268 |
| HI1368 | 1450325 | 1452928 | topoisomerase I (topA) (*Escherichia coli*) | 72.0 | 84.3 | 855 |
| HI0446 | 464736 | 466688 | topoisomerase III (tpoB) (*Escherichia coli*) | 65.9 | 79.4 | 645 |
| HI1535 | 1598641 | 1601881 | topoisomerase IV subunit A (parC) (*Escherichia coli*) | 71.4 | 65.4 | 727 |
| HI1534 | 1597767 | 1599571 | topoisomerase IV subunit B (parE) (*Escherichia coli*) | 76.5 | 88.6 | 630 |
| HI1261 | 1331575 | 1335011 | transcription-repair coupling factor (trcF) (mld) (*Escherichia coli*) | 64.3 | 82.7 | 1134 |
| HI0217 | 232884 | 234038 | type I restriction enzyme ecokI specificity protein (hsdS) (*Escherichia coli*) | 36.1 | 58.6 | 394 |
| HI0216 | 231281 | 232797 | type I restriction enzyme ECOR124/3 I M protein (hsdM) (*Escherichia coli*) | 81.2 | 89.3 | 512 |
| HI1290 | 1368549 | 1367223 | type I restriction enzyme ECOR124/3 I M protein (hsdM) (*Escherichia coli*) | 30.4 | 53.7 | 332 |
| HI1288 | 1365756 | 1362592 | type I restriction enzyme ECOR124/3 R protein (hsdR) (*Escherichia coli*) | 30.4 | 52.7 | 991 |
| HI1059 | 1123091 | 1121206 | type III restriction-modification ECOP15 enzyme (mod) (*Escherichia coli*) | 36.5 | 55.5 | 384 |
| HI0018 | 18087 | 18743 | uracil DNA glycosylase (ung) (*Escherichia coli*) | 70.2 | 79.5 | 215 |
| HI0311 | 342051 | 342941 | aprB protein (merD) (*Escherichia coli*) | 68.9 | 84.8 | 296 |
| Degradation of DNA | | | | | | |
| HI1698 | 1756680 | 1759312 | endonuclease III (nth) (*Escherichia coli*) | 83.4 | 91.9 | 211 |
| HI0250 | 278526 | 281829 | excinuclease ABC subunit A (uvrA) (*Escherichia coli*) | 81.2 | 91.0 | 940 |
| HI1250 | 1323924 | 1321888 | excinuclease ABC subunit B (uvrB) (*Escherichia coli*) | 78.0 | 87.7 | 669 |
| HI0057 | 68893 | 67067 | excinuclease ABC subunit C (uvrC) (*Escherichia coli*) | 65.9 | 80.0 | 588 |
| HI0380 | 1471626 | 1473044 | exodeoxyribonuclease I (abcB) (*Escherichia coli*) | 57.5 | 74.9 | 462 |
| HI1324 | 1395898 | 1399530 | exodeoxyribonuclease V (recB) (*Escherichia coli*) | 37.1 | 58.2 | 1165 |
| HI0944 | 998895 | 1002257 | exodeoxyribonuclease V (recC) (*Escherichia coli*) | 40.1 | 61.2 | 1114 |
| HI1325 | 1399533 | 1401452 | exodeoxyribonuclease V (recD) (*Escherichia coli*) | 40.0 | 59.3 | 570 |
| HI0041 | 43872 | 43072 | exonuclease III (xthA) (*Escherichia coli*) | 71.9 | 83.9 | 267 |
| HI0399 | 417972 | 419288 | exonuclease VII, large subunit (xseA) (*Escherichia coli*) | 57.8 | 74.4 | 437 |
| HI1217 | 1280795 | 1282519 | single-stranded-DNA-specific exonuclease (recJ) (*Escherichia coli*) | 59.2 | 77.3 | 554 |

-continued

Transcription

RNA synthesis, modification and DNA transcription

| | | | | | | |
|---|---|---|---|---|---|---|
| HI0618 | 647724 | 650492 | ATP-dependent helicase HEPA (hepA) (*Escherichia coli*) | 53.6 | 73.6 | 968 |
| HI0424 | 444751 | 443435 | ATP-dependent RNA helicase (srmB) (*Escherichia coli*) | 39.8 | 60.9 | 448 |
| HI0232 | 260978 | 262816 | ATP-dependent RNA helicase DEAD (deaD) (*Escherichia coli*) | 64.0 | 78.6 | 613 |
| HI0604 | 851485 | 852468 | DNA-directed RNA polymerase alpha chain (rpoA) (*Escherichia coli*) | 91.8 | 97.0 | 329 |
| HI0517 | 534212 | 538670 | DNA-directed RNA polymerase beta chain (rpoB) (*Salmonella typhimunum*) | 83.3 | 91.9 | 1342 |
| HI0516 | 534211 | 529967 | DNA-directed RNA polymerase beta' chain (rpoC) (*Escherichia coli*) | 83.0 | 90.7 | 1399 |
| HI1307 | 1383078 | 1383509 | N utilization sustance protein B (nusB) (*Escherichia coli*) | 54.9 | 71.4 | 133 |
| HI0063 | 65915 | 67269 | plasmid copy number control protein (pcnB) (*Escherichia coli*) | 55.7 | 73.4 | 404 |
| HI0230 | 257702 | 259828 | polynucleotide phosphorylase (pnp) (*Escherichia coli*) | 74.2 | 86.7 | 708 |
| HI0694 | 944630 | 945883 | putative ATP-dependent RNA helicase (rhlB) (*Escherichia coli*) | 73.9 | 84.1 | 410 |
| HI1748 | 1828594 | 1828331 | RNA polymerase omega subunit (rpoZ) (*Escherichia coli*) | 64.8 | 76.1 | 88 |
| HI1463 | 1542205 | 1541024 | sigma factor (algU) (*Pseudomones seruginosa*) | 27.6 | 48.8 | 168 |
| HI0719 | 764847 | 765401 | transcription antitermination protein (nutG) (*Escherichia coli*) | 73.7 | 64.4 | 179 |
| HI0671 | 569932 | 590405 | transcription elongation factor (graB) (*Escherichia coli*) | 61.5 | 79.5 | 156 |
| HI1266 | 1358486 | 1360006 | transcription factor (nusA) (*Salmonella typhimunum*) | 70.8 | 84.1 | 499 |
| HI0297 | 328437 | 329696 | transcription termination factor rho (rho) (*Escherichia coli*) | 87.4 | 95.2 | 419 |

Degradation of RNA

| | | | | | | |
|---|---|---|---|---|---|---|
| HI0219 | 234848 | 234923 | anticodon nuclease meeting-agent (prrD) (*Escherichia coli*) | 72.9 | 85.6 | 291 |
| HI1739 | 1810586 | 1809610 | exoribonuclease II (RNeeell) (*Escherichia coli*) | 50.8 | 68.0 | 586 |
| HI0392 | 411354 | 412550 | ribonuclease D (rnd) (*Escherichia coli*) | 41.3 | 65.5 | 365 |
| HI0415 | 433540 | 436392 | ribonuclease E (rne) (*Escherichia coli*) | 60.3 | 72.3 | 1058 |
| HI0139 | 152730 | 153181 | ribonuclease H (rnh) (*Escherichia coli*) | 64.9 | 78.0 | 154 |
| HI1061 | 1124258 | 1123668 | ribonuclease HII (EC 31264) (RNASE H12) (*Escherichia coli*) | 73.7 | 82.8 | 135 |
| HI0014 | 14422 | 13742 | ribonuclease III (rnc) (*Escherichia coli*) | 65.3 | 80.2 | 221 |
| HI0275 | 306539 | 305826 | ribonuclease PH 9rph) (*Escherichia coli*) | 79.9 | 87.8 | 237 |
| HI1001 | 1063336 | 1063743 | RNase P (rnpA) (*Escherichia coli*) | 69.7 | 80.7 | 119 |
| HI0326 | 351726 | 352412 | RNase T (rnt) (*Escherichia coli*) | 65.7 | 80.9 | 204 |

Translation

Ribosomal proteins - synthesis, modification

| | | | | | | |
|---|---|---|---|---|---|---|
| HI0516 | 539557 | 538871 | ribosomal protein L1 (rpL1) (*Escherichia coli*) | 85.6 | 93.4 | 229 |
| HI0642 | 681369 | 681857 | ribosomal protein L10 (rpL10) (*Salmonella typhimunum*) | 80.5 | 89.0 | 165 |
| HI0519 | 539990 | 539565 | ribosomal protein L11 (rpL11) (*Escherichia coli*) | 86.6 | 94.4 | 142 |
| HI0960 | 1035484 | 1036371 | ribosomal protein L11 methyltransferase (prmA) (*Escherichia coli*) | 69.2 | 83.2 | 291 |
| HI1447 | 1530773 | 1530348 | ribosomal protein L13 (rpL13) (*Haemophilus somnus*) | 94.4 | 95.8 | 142 |
| HI0790 | 844379 | 844747 | ribosomal protein L14 (rpL14) (*Escherichia coli*) | 94.3 | 98.4 | 123 |
| HI0799 | 847996 | 848427 | ribosomal protein L15 (rpL15) (*Escherichia coli*) | 82.6 | 91.0 | 144 |
| HI0786 | 842244 | 842651 | ribosomal protein L16 (rpL16) (*Escherichia coli*) | 89.7 | 95.6 | 136 |
| HI0805 | 852512 | 852695 | ribosomal protein L17 (rpTQ) (*Escherichia coli*) | 89.8 | 92.1 | 127 |
| HI0796 | 846938 | 847288 | ribosomal protein L18 (rpL18) (*Escherichia coli*) | 84.6 | 91.5 | 117 |
| HI0202 | 216787 | 216440 | ribosomal protein L19 (rpL19) (*Escherichia coli*) | 89.5 | 98.2 | 114 |
| HI0782 | 840039 | 840857 | ribosomal protein L2 (rpL2) (*Escherichia coli*) | 85.7 | 93.4 | 273 |
| HI1323 | 1395432 | 1395782 | ribosomal protein L20 (rpL20) (*Escherichia coli*) | 94.0 | 96.6 | 117 |
| HI0682 | 932097 | 931789 | ribosomal protein L21 (rpL21) (*Escherichia coli*) | 79.6 | 86.4 | 103 |
| HI0784 | 841173 | 841502 | ribosomal protein L22 (rpL22) (*Escherichia coli*) | 91.8 | 97.3 | 110 |
| HI0781 | 839722 | 840018 | ribosomal protein L23 (rpL23) (*Escherichia coli*) | 71.7 | 82.8 | 99 |
| HI0791 | 844761 | 845069 | ribosomal protein L24 (rpL24) (*Escherichia coli*) | 76.7 | 86.4 | 103 |
| HI1636 | 1692153 | 1692437 | ribosomal protein L25 (rpL25) (*Escherichia coli*) | 61.9 | 77.4 | 84 |
| HI0881 | 931428 | 931788 | ribosomal protein L27 (rpL27) (*Escherichia coli*) | 87.1 | 90.6 | 85 |
| HI0953 | 1010494 | 1010261 | ribosomal protein L28 (rpL28) (*Escherichia coli*) | 85.7 | 94.8 | 77 |
| HI0787 | 842654 | 842842 | ribosomal protein L29 (rpL29) (*Escherichia coli*) | 75.6 | 87.1 | 62 |
| HI0779 | 838461 | 839104 | ribosomal protein L3 (rpL3) (*Escherichia coli*) | 85.2 | 92.3 | 209 |
| HI0798 | 847813 | 847989 | ribosomal protein L30 (rpL30) (*Escherichia coli*) | 79.7 | 56.4 | 59 |
| HI0760 | 821826 | 821617 | ribosomal protein L31 (rpL31) (*Escherichia coli*) | 71.4 | 85.7 | 70 |
| HI0159 | 174441 | 174274 | ribosomal protein L32 (rpL32) (*Escherichia coli*) | 77.2 | 86.0 | 57 |
| HI0952 | 1010246 | 1010079 | ribosomal protein L33 (rpL33) (*Escherichia coli*) | 81.5 | 90.7 | 54 |
| HI1000 | 1063233 | 1063364 | ribosomal protein L34 (rpL34) (*Escherichia coli*) | 86.4 | 93.2 | 44 |
| HI1322 | 1395095 | 1395289 | ribosomal protein L35 (rpL35) (*Escherichia coli*) | 75.0 | 90.6 | 32 |
| HI0760 | 839722 | 839776 | ribosomal protein L4 (rpL4) (*Escherichia coli*) | 83.8 | 83.0 | 201 |
| HI0792 | 845090 | 845626 | ribosomal protein L5 (rpL5) (*Escherichia coli*) | 90.5 | 96.1 | 179 |
| HI0795 | 846391 | 846921 | ribosomal protein L6 (rpL6) (*Escherichia coli*) | 75.1 | 90.4 | 177 |
| HI0643 | 681915 | 682283 | ribosomal protein L7/L12 (rpL7/L12) (*Escherichia coli*) | 82.0 | 91.8 | 121 |
| HI0546 | 567819 | 567173 | ribosomal protein L9 (rpL9) (*Escherichia coli*) | 72.5 | 85.9 | 149 |
| HI1223 | 1289629 | 1291274 | ribosomal protein S1 (rpS1) (*Escherichia coli*) | 79.3 | 88.7 | 557 |
| HI0778 | 838108 | 838461 | ribosomal protein S10 (rpS10) (*Escherichia coli*) | 98.1 | 99.0 | 103 |
| HI0802 | 850416 | 850802 | ribosomal protein S11 (rpS11) (*Escherichia coli*) | 92.2 | 96.1 | 129 |
| HI0601 | 850045 | 850397 | ribosomal protein S13 (rpS13) (*Escherichia coli*) | 86.4 | 93.2 | 118 |
| HI0793 | 845641 | 845943 | ribosomal protein S14 (rpS14) (*Escherichia coli*) | 89.9 | 94.9 | 99 |
| HI1331 | 1405806 | 1406072 | ribosomal protein S15 (rpS15) (*Escherichia coli*) | 80.9 | 86.5 | 89 |
| HI1473 | 1554091 | 1553825 | ribosomal protein S15 (rpS15) (*Escherichia coli*) | 80.9 | 86.6 | 89 |
| HI0205 | 218422 | 218177 | ribosomal protein S16 (rpS16) (*Escherichia coli*) | 70.7 | 85.4 | 82 |
| HI0788 | 842845 | 843099 | ribosomal protein S17 (rpS17) (*Escherichia coli*) | 85.7 | 94.0 | 84 |
| HI0547 | 567883 | 567839 | ribosomal protein S18 (rpS18) (*Escherichia coli*) | 92.0 | 94.7 | 75 |

-continued

| | | | | | | |
|---|---|---|---|---|---|---|
| HI0783 | 840886 | 841158 | ribosomal protein S19 (rpS19) (*Escherichia coli*) | 90.1 | 97.9 | 91 |
| HI0915 | 967259 | 968041 | ribosomal protein S2 (rpS2) (*Escherichia coli*) | 82.2 | 89.2 | 241 |
| HI0533 | 553446 | 553858 | ribosomal protein S21 (rpS21) (*Escherichia coli*) | 83.1 | 87.3 | 71 |
| HI0785 | 841523 | 842227 | ribosomal protein S3 (rpS3) (*Escherichia coli*) | 87.2 | 93.2 | 233 |
| HI0803 | 850833 | 851450 | ribosomal protein S4 (rpS4) (*Escherichia coli*) | 89.3 | 94.7 | 206 |
| HI0797 | 847306 | 847803 | ribosomal protein S5 (rpS5) (*Escherichia coli*) | 92.8 | 95.8 | 166 |
| HI0549 | 568586 | 568592 | ribosomal protein S6 (rpS6) (*Escherichia coli*) | 76.8 | 87.2 | 125 |
| HI1537 | 1604087 | 1603182 | ribosomal protein S6 modification protein (nmK) (*Escherichia coli*) | 45.3 | 69.0 | 272 |
| HI0582 | 599803 | 599336 | ribosomal protein S7 (rpS7) (*Escherichia coli*) | 89.7 | 94.2 | 155 |
| HI0794 | 845983 | 846372 | ribosomal protein S8 (rpS8) (*Escherichia coli*) | 86.2 | 90.8 | 130 |
| HI1446 | 1530328 | 1529939 | ribosomal protein S9 (rpS9) (*Haemophilus somnus*) | 94.5 | 98.5 | 130 |
| HI0010 | 11292 | 10826 | ribosomal-protein-alanine acetyltransferase (nml) (*Escherichia coli*) | 55.9 | 73.1 | 144 |
| HI0583 | 600334 | 599963 | streptomycin resistance protein (strA) (*Haemophylis influenzae*) | 100.0 | 100.0 | 124 |
| Amino acyl tRNA Synthetases, tRNA modification | | | | | | |
| HI0816 | 865547 | 862926 | alanyl-tRNA synthetase (alaS) (*Escherichia coli*) | 68.2 | 82.6 | 873 |
| HI1589 | 1648885 | 1650415 | arginyl-tRNA synthetase (argS) (*Escherichia coli*) | 71.2 | 83.5 | 577 |
| HI1305 | 1382405 | 1380975 | asparaginyl-tRNA synthetase (asnS) (*Escherichia coli*) | 80.6 | 90.8 | 665 |
| HI0319 | 348931 | 347168 | aspertyl-tRNA synthetase (aspS) (*Escherichia coli*) | 76.2 | 85.5 | 585 |
| HI0078 | 85367 | 83991 | cys-tRNA synthetase (cysS) (*Escherichia coli*) | 75.7 | 87.0 | 461 |
| HI0710 | 753356 | 754738 | cysteinyl-tRNA (ser) selenium transferase (retA) (*Escherichia coli*) | 58.8 | 75.6 | 454 |
| HI1357 | 1431798 | 1433466 | glutaminyl-tRNA synthetase (glnS) (*Escherichia coli*) | 75.7 | 86.9 | 547 |
| HI0276 | 308282 | 308843 | glutamyl-tRNA synthetase (gllX) (*Escherichia coli*) | 72.4 | 84.3 | 464 |
| HI0929 | 985024 | 984119 | glycyl-tRNA synthetase alpha chain (glyO) (*Escherichia coli*) | 90.6 | 94.6 | 290 |
| HI0926 | 983066 | 981002 | glycyl-tRNA synthetase beta chain (glyS) (*Escherichia coli*) | 69.7 | 81.9 | 689 |
| HI0371 | 392076 | 393344 | histidine-tRNA synthetase (hisS) (*Escherichia coli*) | 66.8 | 79.1 | 421 |
| HI0964 | 1021072 | 1018250 | isoleucyl-tRNA ligase (ileS) (*Escherichia coli*) | 66.0 | 78.5 | 834 |
| HI0923 | 976547 | 979129 | leucyl-tRNA synthetase (leuS) (*Escherichia coli*) | 72.3 | 82.2 | 859 |
| HI1214 | 1276435 | 1276930 | lysyl-tRNA synthetase (lysU) (*Escherichia coli*) | 70.2 | 84.3 | 505 |
| HI0838 | 885271 | 886269 | lysyl-tRNA synthetase analog (genX) (*Escherichia coli*) | 62.7 | 78.5 | 331 |
| HI0625 | 662613 | 663566 | methionyl-tRNA formyltransferase (fmt) (*Escherichia coli*) | 65.0 | 77.4 | 313 |
| HI1279 | 1353301 | 1351256 | methionyl-tRNA synthetase (metG) (*Escherichia coli*) | 69.0 | 83.3 | 677 |
| HI0396 | 416276 | 415697 | peptidyl-tRNA hydrolase (pth) (*Escherichia coli*) | 64.2 | 80.5 | 190 |
| HI1314 | 1387890 | 1388876 | phenylalanyl-tRNA synthetase beta-subunit (pheS) (*Escherichia coli*) | 75.0 | 82.0 | 327 |
| HI1315 | 1388713 | 1391097 | phenylalanyl-tRNA synthetase beta-subunit (pheT) (*Escherichia coli*) | 65.3 | 80.1 | 795 |
| HI0731 | 781970 | 783684 | prolyl-tRNA synthetase (proS) (*Escherichia coli*) | 74.9 | 86.8 | 570 |
| HI1615 | 1709685 | 1708879 | pseudouridylate synthetase I (hisT) (*Escherichia coli*) | 69.2 | 82.7 | 260 |
| HI0246 | 273589 | 272501 | queuosine biosynthesis protein (queA) (*Escherichia coli*) | 72.5 | 55.7 | 346 |
| HI0201 | 215333 | 216439 | selenium metabolism protein (selD) (*Escherichia coli*) | 66.1 | 80.6 | 330 |
| HI0110 | 117234 | 118520 | seryl-tRNA synthetase (serS) (*Escherichia coli*) | 77.6 | 56.5 | 430 |
| HI1370 | 1453876 | 1455804 | threonyl-tRNA synthetase (thrS) (*Escherichia coli*) | 77.9 | 86.1 | 842 |
| HI0245 | 272154 | 271009 | transfer RNA-guanine transglycosylase (tgt) (*Escherichia coli*) | 81.3 | 91.5 | 374 |
| HI0203 | 217564 | 216827 | tRNA (guanine-N1)-methyltransferase (M1G-methyltransferase) (trmD) (*Escherichia coli*) | 83.2 | 93.0 | 244 |
| HI0650 | 894301 | 895369 | tRNA (uracil-5-)-methyltransferase (trmA) (*Escherichia coli*) | 64.6 | 80.4 | 362 |
| HI0088 | 71519 | 72451 | tRNA delta(2)-isopentenylpyrophosphate transferase (trpX) (*Escherichia coli*) | 69.8 | 87.4 | 300 |
| HI1612 | 1671420 | 1672667 | tRNA nucleolidyltransferase (coa) (*Escherichia coli*) | 59.4 | 73.4 | 464 |
| HI0242 | 270097 | 269807 | tRNA-guanine-transglycosylase (tgt) (*Escherichia coli*) | 62.4 | 81.7 | 92 |
| HI0658 | 678958 | 677957 | tryptophanyl-tRNA synthetase (trpS) (*Escherichia coli*) | 78.1 | 86.2 | 334 |
| HI1616 | 1676533 | 1675341 | tyrosyl tRNA synthetase (tyrS) (*Thiobacillus lericoxidana*) | 53.6 | 72.6 | 398 |
| HI1396 | 1490259 | 1487398 | valyl-tRNA synthetase (vetS) (*Escherichia coli*) | 70.8 | 83.3 | 951 |
| Nucleoproteins | | | | | | |
| HI0187 | 200140 | 200544 | DNA binding protein (probable) (*Bacillus subtilis*) | 43.4 | 64.2 | 106 |
| HI1496 | 1568481 | 1568685 | DNA-binding protein (rdgB) (*Ervinis carotovora*) | 42.4 | 60.8 | 67 |
| HI1593 | 1855153 | 1855554 | DNA-binding protein H-NS (hns) (*Escherichia coli*) | 47.4 | 65.2 | 136 |
| HI0432 | 453511 | 453104 | DNA-binding protein HU-ALPHA (NS2) (HU-2) (*Escherichia coli*) | 78.9 | 86.7 | 90 |
| Proteins - transition and modification | | | | | | |
| HI0648 | 883035 | 883757 | disulfide oxidoreductase (por) (*Haemophilus influenzae*) | 100.0 | 100.0 | 205 |
| HI0987 | 1042200 | 1041082 | DNA processing chain A (dprA) (*Escherichia coli*) | 44.8 | 80.2 | 358 |
| HI0916 | 968177 | 968025 | elongation factor EF-Ts (tsf) (*Escherichia coli*) | 71.4 | 85.0 | 260 |
| HI0580 | 597082 | 595901 | elongation factor EF-Tu (duplicate) (tufS) (*Escherichia coli*) | 92.6 | 95.9 | 384 |
| HI0634 | 671167 | 672348 | elongation factor EF-Tu (duplicate) (tufS) (*Escherichia coli*) | 92.6 | 95.9 | 384 |
| HI0581 | 599249 | 597150 | elongation factor G (fusA) (*Escherichia coli*) | 84.8 | 92.0 | 704 |
| HI0330 | 355817 | 355054 | elongation factor P (efp) (*Escherichia coli*) | 75.0 | 85.6 | 188 |
| HI0069 | 72460 | 75402 | glutamate-ammonia-ligase adenylyltransferase (ginE) (*Escherichia coli*) | 52.5 | 69.7 | 914 |
| HI1321 | 1394551 | 1394954 | initiation factor 3 (infC) (*Escherichia coli*) | 82.6 | 94.8 | 134 |
| HI0580 | 569019 | 568788 | initiation factor lf-1 (infA) (*Escherichia coli*) | 94.4 | 96.6 | 72 |
| HI1287 | 1360021 | 1362507 | initiation factor lf-2 (infB) (*Escherichia coli*) | 70.9 | 84.6 | 842 |
| HI1155 | 1218859 | 1220211 | maturation antibiotic MccB17 (prrbA) (*Escherichia coli*) | 80.8 | 76.7 | 450 |
| HI1728 | 1794724 | 1793921 | methionine aminopeptidase (map) (*Escherichia coli*) | 84.3 | 79.8 | 282 |
| HI0430 | 450570 | 451100 | oxido-reductase (dabB) (*Escherichia coli*) | 43.8 | 68.8 | 174 |
| HI1215 | 1279684 | 1278589 | peptide chain release factor 2 (prfB) (*Salmonella typhrimunum*) | 81.7 | 93.7 | 385 |
| HI1741 | 1811636 | 1813216 | peptide-chain-relase factor 3 (prfC) (*Escherichia coli*) | 86.0 | 93.4 | 527 |
| HI0079 | 85470 | 85976 | peptidyl-prolyl cis-trans isomerase B (ppiB) (*Escherichia coli*) | 71.3 | 80.5 | 83 |
| HI1567 | 1831427 | 1830345 | polypeptide chain release factor 1 (prfA) (*Salmonella typhrimunum*) | 72.5 | 88.3 | 360 |

-continued

| | | | | | | |
|---|---|---|---|---|---|---|
| HI0624 | 862011 | 862517 | polypeptide deformylase (formylmethionine deformylase) (def) (*Escherichia coli*) | 65.1 | 79.9 | 179 |
| HI0810 | 857270 | 856716 | ribosome releasing factor (frr) (*Escherichia coli*) | 68.1 | 84.9 | 185 |
| HI0575 | 593158 | 592940 | rotamase, peptidyl prolyl cis-trans isomearase (alyD) (*Escherichia coli*) | 50.7 | 73.1 | 87 |
| HI0701 | 745982 | 745413 | rotamase, peptidyl prolyl cis-trans isomearase (alyD) (*Escherichia coli*) | 68.3 | 79.4 | 187 |
| HI1334 | 1408450 | 1408923 | transcription elongation factor (greA) (*Escherichia coli*) | 79.7 | 89.9 | 158 |
| HI0711 | 754738 | 756593 | translation factor (selB) (*Escherichia coli*) | 44.0 | 64.7 | 606 |
| HI1216 | 1279817 | 1280500 | xprA protein (xprA) (*Escherichia coli*) | 45.4 | 67.4 | 227 |
| Degradation of proteins, peptides, glycopeptides | | | | | | |
| HI0877 | 927500 | 928801 | aminopeptidase A (pepA) (*Rickettsia prowazakil*) | 39.6 | 57.9 | 313 |
| HI1711 | 1775967 | 1777439 | aminopeptidase a/1 (pepA) (*Escherichia coli*) | 57.3 | 77.5 | 497 |
| HI1620 | 1682194 | 169586 | aminopeptidase N (pepN) (*Escherichia coli*) | 60.9 | 75.6 | 864 |
| HI0818 | 867554 | 886265 | aminopeptidase P (pepP) (*Escherichia coli*) | 54.6 | 73.6 | 436 |
| HI0716 | 762461 | 763039 | ATP-dependent clp protease protaclytac component (clpP) (*Escherichia coli*) | 71.0 | 88.1 | 193 |
| HI0717 | 763052 | 764284 | ATP-dependent protease ATPase subunit (clpX) (*Escherichia coli*) | 70.2 | 83.2 | 413 |
| HI0661 | 906379 | 908946 | ATP-dependent protease binding subunit(clpS) (*Escherichia coli*) | 77.4 | 88.6 | 867 |
| HI0421 | 440910 | 442289 | collagenase activity collagenase (prtC) (*Porphyromonas gingivatis*) | 31.1 | 53.4 | 206 |
| HI0151 | 166695 | 165811 | HFLC protein (hllC) (*Escherichia coli*) | 56.5 | 78.2 | 329 |
| HI0248 | 274175 | 276400 | IgA1 protease (iga1) (*Haemophilus influenzae*) | 29.8 | 51.5 | 759 |
| HI0992 | 1047674 | 1053118 | IgA1 protease (iga1) (*Haemophilus influenzae*) | 99.8 | 89.9 | 1702 |
| HI0249 | 278527 | 276401 | IgA1 protease (iga1) (*Haemophilus influenzae*) | 45.2 | 62.5 | 791 |
| HI1327 | 1402067 | 1403869 | lon protease (lon) (*Bacillus brevis*) | 24.2 | 46.6 | 714 |
| HI0215 | 229004 | 231046 | oligopeptidase A (prtC) (*Escherichia coli*) | 72.0 | 64.8 | 679 |
| HI0877 | 716670 | 718121 | peptidase D (pepD) (*Escherichia coli*) | 96.9 | 72.2 | 485 |
| HI0688 | 806842 | 607865 | peptidase E (pepE) (*Escherichia coli*) | 41.4 | 80.0 | 214 |
| HI1361 | 1423832 | 1425067 | peptidase T (pepT) (*Salmonella typhimunum*) | 53.3 | 71.4 | 399 |
| HI1202 | 1336467 | 1335070 | periplasmicserine protease Do and heat shock protein (htrA) (*Escherichia coli*) | 55.8 | 73.9 | 469 |
| HI1603 | 1664836 | 1663212 | probable ATP-dependent protease (ams) (*Escherichia coli*) | 80.0 | 92.2 | 460 |
| HI0724 | 768169 | 768784 | proline dipeptidase (pepO) (*Escherichia coli*) | 53.7 | 70.2 | 204 |
| HI0137 | 161209 | 161901 | protease (prtH) (*Porphyromones gingivitas*) | 52.6 | 64.9 | 57 |
| HI1547 | 1813228 | 1611384 | protease V (appA) (*Escherichia coli*) | 43.7 | 64.0 | 807 |
| HI0152 | 167827 | 166898 | protease specific for phage lembda ctl repressor (hllK) (*Escherichia coli*) | 55.8 | 72.6 | 396 |
| HI1688 | 1751031 | 1752089 | putative protease (schS) (*Escherichia coli*) | 53.3 | 74.5 | 348 |
| HI0632 | 553214 | 552189 | alaloglycoprotease (gcp) (*Psateurella haemolyeca*) | 81.8 | 91.5 | 319 |
| Transport binding proteins | | | | | | |
| Amino acids, peptides, amines | | | | | | |
| HI1183 | 1247387 | 1246659 | arginine transport ATP-binding protein artP (artP) (*Escherichia coli*) | 65.8 | 83.1 | 242 |
| HI1180 | 1245260 | 1244570 | arginine transport system permease protein (artM) (*Escherichia coli*) | 55.7 | 79.9 | 218 |
| HI1181 | 1245916 | 1245283 | arginine transport system permease protein (artO) (*Escherichia coli*) | 59.0 | 77.8 | 229 |
| HI0254 | 284235 | 283756 | biopolymer transport protein (subB) (*Haemophilus influenzae*) | 96.0 | 99.7 | 150 |
| HI0253 | 283779 | 283339 | biopolymer transport protein (subD) (*Escherichia coli*) | 29.8 | 55.1 | 118 |
| HI1734 | 1801710 | 1800520 | branched chain as transport system II carrier protein (brcB) (*Pesudomones aeruginosa*) | 28.4 | 49.8 | 279 |
| HI0866 | 936618 | 934149 | D-alanine permease (degA) (*Alteromones heloplaridis*) | 43.2 | 65.6 | 527 |
| HI1199 | 1251117 | 1250128 | dipeptide transport ATP-binding protein (dppD) (*Escherichia coli*) | 74.2 | 84.0 | 328 |
| HI1187 | 1250122 | 1249142 | dipeptide transport ATP-binding protein (dppF) (*Escherichia coli*) | 78.4 | 87.1 | 325 |
| HI1126 | 1189626 | 1188709 | dipeptide transport system permease protein (dppB) (*Escherichia coli*) | 34.1 | 80.7 | 337 |
| HI1190 | 1283029 | 1282031 | dipeptide transport system permease protein (dppB) (*Escherichia coli*) | 61.1 | 79.2 | 337 |
| HI1189 | 1252013 | 1251130 | dipeptide transport system permease protein (dppC) (*Escherichia coli*) | 63.8 | 83.3 | 287 |
| HI1636 | 1601926 | 1603137 | glutamate permease (gltS) (*Escherichia coli*) | 53.9 | 73.0 | 391 |
| HI1061 | 1146102 | 1146389 | glutamine transport system permease protein (glnP) (*Escherichia coli*) | 37.8 | 59.0 | 272 |
| HI1062 | 1146859 | 1148089 | glutamine-binding pertplasmic protein (glnH) (*Escherichia coli*) | 28.4 | 48.2 | 222 |
| HI0410 | 429066 | 428283 | glucine-specific transport protein (ltvG) (*Escherichia coli*) | 28.1 | 55.2 | 250 |
| HI0227 | 266066 | 254375 | membrane-associated component, LIV-# transport system (brnO) (*Salmonella typhimunum*) | 32.9 | 80.4 | 425 |
| HI0214 | 228528 | 226987 | oligopeptide binding protein (oppA) (*Escherichia coli*) | 31.7 | 53.6 | 473 |
| HI1127 | 1191333 | 1190710 | oligopeptide binding protein (oppA) (*Escherichia coli*) | 52.6 | 66.0 | 527 |
| HI1124 | 1187751 | 1186783 | oligopeptide transport ATP-binding protein (oppD) (*Salmonella typhimunum*) | 77.2 | 85.0 | 320 |
| HI1123 | 1186783 | 1185758 | oligopeptide transport ATP-binding protein (oppF) (*Salmonella typhimunum*) | 71.5 | 83.9 | 329 |
| HI1125 | 1188696 | 1187764 | oligopeptide transport system permease protein (oppC)C (*Salmonella typhimunum*) | 71.1 | 87.4 | 300 |
| HI1644 | 1702355 | 1704049 | peptide transport periplasmic protein (sapA) (*Salmonella typhimunum*) | 33.3 | 63.8 | 504 |
| HI1647 | 1705898 | 1706944 | peptide transport system ATP-binding protein (sapD) (*Salmonella typhimunum*) | 62.4 | 80.0 | 330 |
| HI1162 | 1248838 | 1245922 | periplasmic arginine-binding protein (ard) (*Pasteurella haemolydes*) | 58.6 | 73.4 | 234 |
| HI1157 | 1221270 | 1222588 | proton glutamate symport protein (gltP) (*Bacillus caldotanax*) | 28.6 | 83.6 | 396 |
| HI0692 | 611820 | 610616 | putrescine transport protein (potE) (*Escherichia coli*) | 77.3 | 96.0 | 434 |
| HI0291 | 324543 | 323308 | serine transporter (adaC) (*Escherichia coli*) | 61.0 | 77.8 | 411 |
| HI1350 | 1423563 | 1422421 | aspermidine/putrescine transport ATP-binding protein (potA) (*Escherichia coli*) | 68.1 | 83.1 | 378 |
| HI1349 | 1422434 | 1421577 | spermidine/putrescine transport system permease protein (potB) (*Escherichia coli*) | 61.5 | 83.6 | 275 |
| HI1348 | 1421548 | 1420808 | spermidine/putrescine transport system permease protein (potC) (*Escherichia coli*) | 72.4 | 88.9 | 243 |

-continued

| | | | | | | |
|---|---|---|---|---|---|---|
| HI0500 | 514110 | 513175 | spermidine/putrescine-binding periplasmic protein precursor (potD) (*Escherichia coli*) | 59.2 | 75.2 | 309 |
| HI1347 | 1420732 | 1419596 | spermidine/putrescine-binding periplasmic protein precursor (potD) (*Escherichia coli*) | 54.1 | 71.5 | 330 |
| HI0289 | 320539 | 321792 | tryptophan-specific permease (mtr) (*Escherichia coli*) | 55.8 | 72.5 | 396 |
| HI0479 | 497529 | 499028 | tyrosine-specific transport protein (tyrP) (*Escherichia coli*) | 48.1 | 68.2 | 401 |
| HI0530 | 551559 | 550342 | tyrosine-specific transport protein (tyrP) (*Escherichia coli*) | 45.4 | 65.4 | 404 |
| Cations | | | | | | |
| HI0255 | 284871 | 284407 | bacteriolerntin comigratory protein (bcp) (*Escherichia coli*) | 62.3 | 79.9 | 154 |
| HI1275 | 1347862 | 1348650 | ferric enterobactin transport ATP-binding protein (fepC) (*Escherichia coli*) | 29.4 | 51.3 | 238 |
| HI1475 | 1555193 | 1554435 | ferric enterobactin transport ATP-binding protein (fepC) (*Escherichia coli*) | 33.2 | 54.8 | 220 |
| HI1471 | 1549654 | 1551853 | ferrichrome-iron receptor (fhuA) (*Escherichia coli*) | 26.4 | 48.9 | 710 |
| HI1388 | 1479930 | 148/0475 | ferritin like protein (rsgA) (*Escherichia coli*) | 57.4 | 79.0 | 162 |
| HI1369 | 1480494 | 1480988 | ferritin like protein (rsgA) (*Escherichia coli*) | 57.3 | 73.8 | 164 |
| HI0363 | 385804 | 384887 | iron(III) dicitrate transport ATP-binding protein FECE (*Escherichia coli*) | 35.9 | 56.4 | 220 |
| HI1274 | 1347324 | 1347861 | iron(III) dicitrate transport system permease protein (fecD) (*Escherichia coli*) | 36.0 | 64.0 | 255 |
| HI1037 | 1099321 | 1100265 | magnesium and cobalt transport protein (corA) (*Escherichia coli*) | 70.3 | 84.8 | 316 |
| HI0097 | 103798 | 104679 | major ferric iron binding protein precursor (fbp) (*Neisseria gonorrhoses*) | 69.7 | 82.3 | 293 |
| HI1051 | 1114308 | 1114635 | mercuric transport protein (merT) (*Pseudomonas aeruginosa*) | 25.0 | 55.2 | 99 |
| HI1052 | 1114651 | 1114926 | mercury scavenger protein (merP) (*Pseudomonas fluorescens*) | 29.3 | 45.7 | 91 |
| HI0294 | 327396 | 327193 | mercury scavenger protein (merP) (*Pseudomonas fluorescens*) | 32.5 | 67.2 | 67 |
| HI1531 | 1594953 | 1594219 | molybdate-binding periplasmic protein precursor (modB) (*Azotobacter vinelendii*) | 21.7 | 43.0 | 245 |
| HI0226 | 254880 | 253681 | NA(+)/H(+) antiporter 1 (nhaA) (*Escherichia coli*) | 52.5 | 74.6 | 380 |
| HI0429 | 448992 | 450557 | na+/H+ antiporter (nhaB) (*Escherichia coli*) | 70.6 | 87.5 | 501 |
| HI1110 | 1171933 | 1170530 | Na+/H+ antiporter (nhaC) (*Bacillus firmus*) | 37.5 | 62.0 | 382 |
| HI0088 | 104899 | 106317 | periplasmic-binding-protein-dependent iron transport protein (sfuB) (*Serratia marcescens*) | 38.1 | 59.5 | 457 |
| HI1479 | 1556763 | 1558167 | periplasmic-binding-protein-dependent iron transport protein (sfuC) (*Serratia marcescens*) | 39.9 | 50.0 | 197 |
| HI0913 | 964424 | 966276 | potassium efflux system (kefC) (*Escherichia coli*) | 40.9 | 65.7 | 594 |
| HI0282 | 326934 | 324769 | potassium/copper-transportING ATPase A (copA) (*Enterococcus laecalis*) | 42.9 | 64.4 | 723 |
| HI1355 | 1429787 | 1428276 | sodium/proline-symporter (proline permease ) (putP) (*Escherichia coli*) | 62.8 | 79.1 | 489 |
| HI0252 | 283326 | 282517 | tonB protein (tonB) (*Haemophilus influenzae*) | 96.2 | 96.5 | 261 |
| HI0627 | 664922 | 666362 | TRK system potassium uptake protein (trkA) (*Escherichia coli*) | 65.8 | 83.4 | 458 |
| Carbohydrates, organic alcohols & acids | | | | | | |
| HI0020 | 22097 | 20661 | 2-oxoglutarate/malate translocator (SODIT1) (*Spinacia oleraosa*) | 35.8 | 59.6 | 452 |
| HI0624 | 872694 | 873940 | D-galactose-binding periplasmic protein (mglB) (*Escherichia coli*) | 57.6 | 81.2 | 329 |
| HI1113 | 1176024 | 1174516 | D-xylose transport ATP-binding protein (xylG) (*Escherichia coli*) | 71.5 | 85.8 | 501 |
| HI1114 | 1177073 | 1176078 | D-xylose-binding periplasmic protein (rbsB) (*Escherichia coli*) | 76.0 | 88.4 | 328 |
| HI1718 | 1785264 | 1783300 | enzyme I (ptaI) (*Salmonella typhimurium*) | 70.2 | 84.3 | 574 |
| HI0182 | 194818 | 193967 | formate transporter (formate channel) (*Escherichia coli*) | 53.2 | 73.4 | 263 |
| HI0450 | 471781 | 470265 | fructose-permease IIA/FPR component (fruB) (*Escherichia coli*) | 51.5 | 65.3 | 374 |
| HI0448 | 469337 | 467870 | fructose-permease IIBC component (FruA) (*Escherichia coli*) | 57.2 | 72.2 | 552 |
| HI0614 | 643282 | 6428551 | fucose operon protein (fucU) (*Escherichia coli*) | 66.3 | 80.0 | 94 |
| HI0692 | 733673 | 734464 | glpF protein (glpF) (*Escherichia coli*) | 73.6 | 97.2 | 258 |
| HI1019 | 1080518 | 1081194 | glpF protein (glpF) (*Escherichia coli*) | 30.6 | 54.6 | 208 |
| HI1017 | 1078404 | 1079887 | gluconate permease (gntP) (*Bacillus subtilis*) | 29.1 | 56.4 | 442 |
| HI1717 | 1783237 | 1782740 | glucose phosphotransferase enzyme III-glc (cir) (*Escherichia coli*) | 73.2 | 83.3 | 169 |
| HI0688 | 729474 | 730914 | glycerol-3-phosphatase transporter (glpT) (*Escherichia coli*) | 64.5 | 78.9 | 445 |
| HI0504 | 517869 | 519347 | high affinity nbose transport protein (rbsA) (*Escherichia coli*) | 71.1 | 85.4 | 494 |
| HI0505 | 519363 | 520331 | high affinity nbose transport protein (rbsC) (*Escherichia coli*) | 68.0 | 86.5 | 303 |
| HI0503 | 517436 | 517852 | high affinity nbose transport protein (rbsD) (*Escherichia coli*) | 59.0 | 78.4 | 139 |
| HI0612 | 642139 | 640856 | L-fucose permease (fucP) (*Escherichia coli*) | 35.6 | 57.9 | 413 |
| HI1221 | 1288578 | 1286983 | L-lactate permease (lctP) (*Escherichia coli*) | 30.2 | 53.9 | 532 |
| HI1735 | 1802527 | 1801757 | lactam utilization protein (lamB) (*Emencella ridulans*) | 41.3 | 60.3 | 130 |
| HI0825 | 874009 | 875526 | mglA protein (mglA) (*Escherichia coli*) | 73.9 | 84.6 | 506 |
| HI0826 | 875545 | 876553 | mglC protein (mglC) (*Escherichia coli*) | 79.2 | 90.2 | 336 |
| HI0506 | 520354 | 521229 | periplasmic ribos-binding protein (rbsB) (*Escherichia coli*) | 73.9 | 86.6 | 291 |
| HI1719 | 1785361 | 1785107 | phosphohistidinoprotein-hexose phosphotransferase (ptsH) (*Escherichia coli*) | 77.6 | 88.2 | 85 |
| HI0830 | 878480 | 878773 | potassium channel homolog (kch) (*Escherichia coli*) | 67.7 | 80.2 | 96 |
| HI0154 | 170140 | 168807 | putative aspartate transport protein (dcuA) (*Escherichia coli*) | 46.4 | 69.9 | 436 |
| HI0748 | 803858 | 805175 | putative aspartate transport protein (dcuA) (*Escherichia coli*) | 42.6 | 70.1 | 435 |
| HI1112 | 1174509 | 1173385 | ribose transport permease protein (xylH) (*Escherichia coli*) | 69.8 | 84.1 | 371 |
| HI1696 | 1759373 | 1760743 | sodium- and chloride-dependent GABA tranporter (*Homo sapiens*) | 29.3 | 52.6 | 471 |
| HI0738 | 790926 | 789403 | sodium-dependent noradrenaline transporter (*Homo sapiens*) | 31.1 | 54.2 | 523 |
| Nucleosides, punnes & pyrimidines | | | | | | |
| HI1069 | 1151815 | 1151024 | ribonucleotide transport ATP-binding protein (ridI) (*Mycobacterium leprae*) | 42.2 | 61.5 | 244 |
| HI1230 | 1296319 | 1295078 | uracil permease (uraA) (*Escherichia coli*) | 37.2 | 61.8 | 400 |
| Anions | | | | | | |
| HI1104 | 1164213 | 1165028 | cysteine synthetase (cysZ) (*Escherichia coli*) | 53.7 | 75.3 | 190 |
| HI1697 | 1761825 | 1760773 | hydrophilic membrane-bound protein (modC) (*Escherichia coli*) | 55.9 | 74.5 | 263 |
| HI1698 | 1762501 | 1761815 | hydrophobic membrane-bound protein (modB) (*Escherichia coli*) | 65.9 | 84.8 | 223 |

-continued

| | | | | | | |
|---|---|---|---|---|---|---|
| HI1384 | 1477430 | 1476585 | integral membrane protein (petA) (*Escherichia coli*) | 59.5 | 77.8 | 272 |
| HI0358 | 380045 | 380764 | nitrate transporter ATPase component (nasD) (*Klebsiella pneumoniae*) | 34.9 | 57.8 | 254 |
| HI1383 | 1475710 | 1476584 | peripheral membrane protein B (pslB) (*Escherichia coli*) | 77.0 | 85.8 | 256 |
| HI1385 | 1478379 | 1477435 | peripheral membrane protein C (pslC) (*Escherichia coli*) | 57.3 | 78.7 | 300 |
| HI1386 | 1479246 | 1478473 | periplasmic phosphate-binding protein (pslS) (*Escherichia coli*) | 49.8 | 67.7 | 256 |
| HI1387 | 1479247 | 1479929 | periplasmic phosphate-binding protein (pslS) (*Escherichia coli*) | 63.8 | 75.4 | 69 |
| HI1610 | 1869474 | 1870733 | phosphate permease(YBR295C) (*Saccharodiryces cerevisise*) | 35.6 | 60.0 | 551 |
| Other | | | | | | |
| HI0060 | 62584 | 60804 | ATP dependent translocator homolog (mabA) (*Haemophilus influenzae*) | 100.0 | 100.0 | 458 |
| HI0623 | 653683 | 662010 | ATP-binding protein (abc) (*Escherichia coli*) | 74.0 | 56.5 | 200 |
| HI1625 | 1686470 | 1686186 | cystic fibrosis transmembrane conductance regulator (*Bos laurus*) | 35.3 | 60.8 | 233 |
| HI0855 | 899042 | 900688 | hame-binding lipoprotein (dppA) (*Haemophilus influenzae*) | 98.9 | 99.3 | 547 |
| HI0256 | 295839 | 298353 | hame-hemopexin-binding protein (hxuA) (*Haemophilus influenzae*) | 82.1 | 89.5 | 928 |
| HI1476 | 1556199 | 1555189 | hemin permease (hemU) (*Yersinis enterocolitica*) | 36.1 | 62.7 | 325 |
| HI0264 | 291684 | 293862 | hemin receptor precursor (hemR) (*Yersinis enterocolitica*) | 28.5 | 45.9 | 678 |
| HI1712 | 1779487 | 1777481 | high-affinity choline transport protein (betT) (*Escherichia coli*) | 34.7 | 61.6 | 653 |
| HI0663 | 705327 | 703054 | lactolerrin binding protein (lbpA) (*Neissena meningitidis*) | 30.2 | 47.9 | 763 |
| HI0610 | 637954 | 639336 | Na+/sulfate cotransporter (*Rattus norvegicus*) | 34.4 | 57.8 | 562 |
| HI0977 | 1032420 | 1033671 | pantothenate permease (panF) (*Escherichia coli*) | 60.2 | 77.9 | 478 |
| HI0714 | 780739 | 757488 | transferrin binding protein 1 precursor (tbp1) (*Neissena menigitidis*) | 29.9 | 48.6 | 894 |
| HI0996 | 1059604 | 1056869 | transferrin binding protein 1 precursor (tbp1) (*Neissena menigitidis*) | 51.2 | 69.5 | 865 |
| HI1220 | 1286725 | 1283987 | transferrin binding protein 1 precursor (tbp1) (*Neissena menigitidis*) | 28.4 | 46.8 | 902 |
| HI0997 | 1061509 | 1059635 | transferrin binding protein 2 precursor (tbp2) (*Neissena menigitidis*) | 39.9 | 54.7 | 692 |
| HI0975 | 1029676 | 1030542 | transferrin-binding protein (tfbA) (*Actinobacillus pleuropneumoniae*) | 28.9 | 48.0 | 578 |
| HI1571 | 1633105 | 1633993 | transferrin-binding protein 1 (tbp1) (*Neissena menigitidis*) | 41.3 | 59.5 | 727 |
| HI0637 | 678956 | 674098 | transferrin-binding protein 1 (tbp2) (*Neissena gonorrhosae*) | 31.6 | 51.7 | 828 |
| HI0665 | 706622 | 708309 | transport ATP-binding protein (cydD) (*Escherichia coli*) | 26.4 | 54.0 | 561 |
| HI1160 | 1226897 | 1225140 | transport ATP-binding protein (cydD) (*Escherichia coli*) | 50.7 | 73.5 | 588 |
| Cellular processes | | | | | | |
| Chaperones | | | | | | |
| HI0544 | 565037 | 565324 | chaperonin (groES) (mop-B) (*Escherichia coli*) | 87.5 | 94.8 | 96 |
| HI0545 | 565360 | 566993 | heat shock protein (groEL) (mopA) (*Haemophilus ducreyi*) | 89.8 | 94.9 | 547 |
| HI1241 | 1310497 | 1311678 | heat shock protein (dnaJ) (*Escherichia coli*) | 68.0 | 82.5 | 376 |
| HI0104 | 111572 | 109680 | heat shock protein C62.5 (htpG) (*Escherichia coli*) | 75.4 | 88.3 | 621 |
| HI0375 | 396463 | 394607 | hac66 protein (hsc68) (*Escherichia coli*) | 69.2 | 82.0 | 616 |
| HI1210 | 1308539 | 1310443 | hsp70 protein (dnaK) (*Escherichia coli*) | 78.5 | 88.2 | 638 |
| Cell division | | | | | | |
| HI0771 | 831200 | 831853 | cell division ATP-binding protein (ttsE) (*Escherichia coli*) | 64.1 | 78.3 | 216 |
| HI1211 | 1275245 | 1274358 | cell division inhibitor (sulA) (*Vibno cholerae*) | 33.9 | 55.7 | 116 |
| HI1145 | 1210058 | 1211332 | cell division protein (ftsA) (*Escherichia coli*) | 52.8 | 74.2 | 420 |
| HI1338 | 1410017 | 1412129 | cell division protein (ftsH) (*Escherichia coli*) | 75.2 | 87.8 | 624 |
| HI1470 | 1549516 | 1548374 | cell division protein (ftsH) (*Escherichia coli*) | 77.8 | 88.3 | 369 |
| HI1337 | 1409390 | 1410016 | cell division protein (ftsJ) (*Escherichia coli*) | 81.7 | 90.4 | 208 |
| HI1134 | 1196901 | 1197221 | cell division protein (ftsL) (*Escherichia coli*) | 36.6 | 60.4 | 101 |
| HI1144 | 1209275 | 1210036 | cell division protein (ftsO) (*Escherichia coli*) | 40.6 | 56.5 | 231 |
| HI1140 | 1204467 | 1205646 | cell division protein (ftsW) (*Escherichia coli*) | 52.3 | 74.9 | 374 |
| HI0770 | 829937 | 831178 | cell division protein (ftsY) (*Escherichia coli*) | 66.0 | 81.1 | 497 |
| HI1146 | 1211419 | 1212681 | cell division protein (ftsZ) (*Escherichia coli*) | 67.2 | 83.1 | 306 |
| HI1377 | 1465224 | 1469780 | cell division protein (multB) (*Escherichia coli*) | 61.4 | 77.3 | 1455 |
| HI1356 | 1429903 | 1431375 | cytoplasmic axial filament protein (cafA) (*Escherichia coli*) | 71.0 | 86.3 | 488 |
| HI0772 | 831866 | 832795 | ftsX protein (ftsX) (*Escherichia coli*) | 43.5 | 69.9 | 292 |
| HI1067 | 1128811 | 1129221 | muliB suppressor protein (smbA) (*Escherichia coli*) | 77.4 | 90.2 | 235 |
| HI1135 | 1197237 | 1199067 | penicillin-binding protein 3 (ltsl) (*Escherichia coli*) | 52.8 | 70.7 | 564 |
| Protein, peptide secretion | | | | | | |
| HI0016 | 17278 | 15485 | GTP-binding membrane protein (lapA) (*Escherichia coli*) | 85.6 | 91.0 | 597 |
| HI1472 | 1551915 | 1553681 | colicin V secretion ATP-binding protein (cvsV) (*Escherichia coli*) | 29.9 | 56.0 | 373 |
| HI1008 | 1070885 | 1071397 | lipoprotein signal peptidase (lspA) (*Escherichia coli*) | 51.3 | 71.5 | 158 |
| HI1648 | 1706947 | 1707753 | peptide transport system ATP-binding protein SAPF (sapF) (*Escherichia coli*) | 49.8 | 70.8 | 264 |
| HI0718 | 764525 | 764842 | preprotein translocase (secE) (*Escherichia coli*) | 40.6 | 62.3 | 106 |
| HI0800 | 848348 | 849760 | preprotein translocase SECY subunit (secY) (*Escherichia coli*) | 74.7 | 86.9 | 443 |
| HI0241 | 269734 | 267887 | protein-export membrane protein (secD) (*Escherichia coli*) | 59.6 | 77.3 | 615 |
| HI0240 | 267876 | 266902 | protein-export membrane protein (secF) (*Escherichia coli*) | 48.0 | 73.0 | 302 |
| HI0447 | 466800 | 467135 | protein-export membrane protein (secG) (*Escherichia coli*) | 58.9 | 81.3 | 110 |
| HI0745 | 801965 | 801459 | protein-export protein (secB) (*Escherichia coli*) | 56.2 | 80.8 | 145 |
| HI0911 | 961135 | 963837 | secA protein (secA) (*Escherichia coli*) | 68.0 | 81.7 | 896 |
| HI0015 | 15473 | 14427 | signal peptidase I (lepB) (*Escherichia coli*) | 46.3 | 65.1 | 319 |
| HI0106 | 114073 | 112688 | signal recognition particle protein (54 homolog) (lth) (*Escherichia coli*) | 79.9 | 90.9 | 452 |
| HI0715 | 781040 | 762335 | trigger factor (tig) (*Escherichia coli*) | 64.4 | 80.3 | 432 |
| HI0298 | 330445 | 329756 | type 4 prepilin-like protein specific leader peptidase (hopD) (*Escherichia coli*) | 27.2 | 49.0 | 208 |
| HI0299 | 331681 | 330445 | xcpS protein (xcpS) (*Pseudomonas putide*) | 29.2 | 56.7 | 396 |
| Detoxification | | | | | | |
| HI0830 | 985290 | 986813 | KW20 catalase (hlrtE) (*Haemophilus influenzae*) | 99.2 | 99.4 | 506 |

-continued

| ID | Start | End | Description | % | % | Len |
|---|---|---|---|---|---|---|
| HI1090 | 1152892 | 1152248 | superoxide dierrulase (sodA) (*Haemophilus influenzae*) | 99.0 | 99.5 | 209 |
| HI1004 | 1065726 | 1057108 | thiophene and furan oxidation protein (thdF) (*Escherichia coli*) | 73.8 | 85.4 | 451 |

Cell killing

| ID | Start | End | Description | % | % | Len |
|---|---|---|---|---|---|---|
| HI0303 | 334601 | 335697 | hemolysin (SyC) (*Serpulina hyodysentenae*) | 36.9 | 57.5 | 252 |
| HI1664 | 1723070 | 1723648 | hemolysin, 21 kDa (hly) (*Actinobacillus pleuropneumonise*) | 54.5 | 72.4 | 156 |
| HI1376 | 1464493 | 1465221 | killing protein (lucA) (*Escherichia coli*) | 69.0 | 83.6 | 222 |
| HI1375 | 1463019 | 1464443 | killing protein suppressor (lucB) (*Escherichia coli*) | 66.9 | 83.0 | 440 |
| HI1053 | 1116898 | 1115057 | leukotosun secretion ATP-binding protein (tktB) (*Actinobacillus actinomycetemcornitans*) | 34.2 | 55.1 | 512 |

Transformation

| ID | Start | End | Description | % | % | Len |
|---|---|---|---|---|---|---|
| HI0436 | 456360 | 455674 | corn101A protein (cornF) (*Haemophilus influenzae*) | 100.0 | 100.0 | 229 |
| HI1010 | 1072519 | 1072854 | competence locus E (cornE1) (*Bacillus subtilis*) | 46.7 | 70.0 | 59 |
| HI0603 | 622277 | 622927 | tfoX protein (tfxO) (*Haemophilus influenzae*) | 99.5 | 99.5 | 217 |
| HI0443 | 462729 | 463571 | transformation gene cluster hypothetical protein (GB:M62809_1) (corn) (*Haemophilus influenzae*) | 100.0 | 100.0 | 281 |
| HI0435 | 455595 | 455002 | transformation gene cluster hypothetical protein (GB:M62809_10) (corn) (*Haemophilus influenzae*) | 99.5 | 99.5 | 198 |
| HI0442 | 460047 | 462638 | transformation gene cluster hypothetical protein (GB:M62809_2) (corn) (*Haemophilus influenzae*) | 100.0 | 100.0 | 864 |
| HI0441 | 460047 | 462638 | transformation gene cluster hypothetical protein (GB:M62809_3) (corn) (*Haemophilus influenzae*) | 100.0 | 100.0 | 265 |
| HI0440 | 459150 | 458647 | transformation gene cluster hypothetical protein (GB:M62809_4) (corn) (*Haemophilus influenzae*) | 100.0 | 100.0 | 168 |
| HI0439 | 456647 | 458129 | transformation gene cluster hypothetical protein (GB:M62809_5) (corn) (*Haemophilus influenzae*) | 100.0 | 100.0 | 173 |
| HI0438 | 458129 | 457719 | transformation gene cluster hypothetical protein (GB:M62809_6) (corn) (*Haemophilus influenzae*) | 100.0 | 100.0 | 137 |
| HI0437 | 457706 | 458365 | transformation gene cluster hypothetical protein (GB:M62809_7) (corn) (*Haemophilus influenzae*) | 99.8 | 99.8 | 441 |

Other categories

Colicin-related functions

| ID | Start | End | Description | % | % | Len |
|---|---|---|---|---|---|---|
| HI0384 | 403297 | 402017 | colicin tolerance protein (tolB) (*Escherichia coli*) | 83.9 | 78.1 | 409 |
| HI1209 | 1272281 | 1272769 | colicin V productin protein (pur regulon) (cvpA) (*Escherichia coli*) | 84.7 | 79.5 | 158 |
| HI0387 | 405650 | 4004967 | inner membrane protein (tolO) (*Escherichia coli*) | 68.8 | 83.3 | 221 |
| HI0386 | 404892 | 404476 | inner membrane protein (tolR) (*Escherichia coli*) | 61.8 | 78.7 | 138 |
| HI0385 | 404457 | 403342 | outer membrane integrity protein (tolA) (*Escherichia coli*) | 42.6 | 57.1 | 406 |
| HI1681 | 1753823 | 1756079 | outer membrane integrity protein (tolA) (*Escherichia coli*) | 26.9 | 47.7 | 345 |

Phage-related functions and prophages

| ID | Start | End | Description | % | % | Len |
|---|---|---|---|---|---|---|
| HI1483 | 1566955 | 1567509 | E16 protein (muE16) (*Bacteriophage mu*) | 28.5 | 52.8 | 143 |
| HI1508 | 1576485 | 1576922 | G protein (muG) (*Bacteriophage mu*) | 38.3 | 52.5 | 147 |
| HI1574 | 1636594 | 1636181 | G protein (muG) (*Bacteriophage mu*) | 33.3 | 54.0 | 138 |
| HI1488 | 1564685 | 1565191 | gam protein (*Bacteriophage mu*) | 57.1 | 73.8 | 188 |
| HI0071 | 78159 | 78860 | heat shock protein B253 (grpE) (*Escherichia coli*) | 45.9 | 86.5 | 193 |
| HI0413 | 432108 | 431836 | host factor-1 (HF-1) (hfq) (*Escherichia coli*) | 90.5 | 97.3 | 74 |
| HI1509 | 1577156 | 1575220 | I protein (mul) (*Bacteriophage mu*) | 50.0 | 55.4 | 58 |
| HI1485 | 1563429 | 1564289 | MuB protein (muB) (*Bacteriophage mu*) | 48.4 | 70.4 | 277 |
| HI1521 | 1584995 | 1586385 | N protein (muN) (*Bacteriophage mu*) | 31.5 | 52.1 | 452 |
| HI1522 | 1586368 | 1587105 | P protein (*Bacteriophage mu*) | 39.5 | 37.3 | 220 |
| HI1418 | 1505940 | 1505428 | terminase subunit 1 (Bacteriophage SF6) | 32.3 | 52.3 | 128 |
| HI1483 | 1560600 | 1562660 | transposase A (muA) (*Bacteriophage mu*) | 40.8 | 50.1 | 596 |

Transposon-related functions

| ID | Start | End | Description | % | % | Len |
|---|---|---|---|---|---|---|
| HI1106 | 1168078 | 1166803 | insertion sequence IS1016(V-4) hypothetical protein (G8:X58176_2) (*Haemophilus influenzae*) | 43.6 | 56.7 | 39 |
| HI1020 | 1081916 | 1081346 | IS1016-V6 protein (IS1016-V6) (*Haemophilus influenzae*) | 91.7 | 93.8 | 191 |
| HI1332 | 1408795 | 1406150 | IS1016-V6 protein (IS1016-V6) (*Haemophilus influenzae*) | 54.7 | 74.7 | 170 |
| HI1583 | 1645515 | 1645991 | IS1016-V6 protein (IS1016-V6) (*Haemophilus influenzae*) | 45.4 | 61.2 | 153 |

Drug/analog sensitivity

| ID | Start | End | Description | % | % | Len |
|---|---|---|---|---|---|---|
| HI0697 | 947919 | 951014 | acriflavine resistance protein (acrB) (*Escherichia coli*) | 32.7 | 55.0 | 1027 |
| HI0302 | 333614 | 334165 | ampD signalling protein (ampD) (*Escherichia coli*) | 56.1 | 75.1 | 172 |
| HI1245 | 1315822 | 1314629 | bicyclomycin resistance protein (bcr) (*Escherichia coli*) | 42.6 | 68.7 | 383 |
| HI1629 | 1688581 | 1689111 | mercury resistance regulatory protein (merR2) (*Thiobacillus ferrooxidans*) | 37.7 | 57.5 | 105 |
| HI0650 | 692523 | 691900 | modulator of drug activity (mda66) (*Escherichia coli*) | 58.1 | 75.4 | 191 |
| HI0699 | 953570 | 952041 | multidrug resistance protein (amrB) (*Escherichia coli*) | 67.7 | 84.8 | 499 |
| HI0900 | 954752 | 953583 | multidrug resistance protein (amrA) (*Escherichia coli*) | 46.5 | 66.3 | 389 |
| HI0036 | 37441 | 39472 | multidrug resistance protein (md1) (*Escherichia coli*) | 29.0 | 51.2 | 1094 |
| HI1467 | 1543471 | 1544832 | nodulation protein T (nodT) (*Rhizobium leguminosarum*) | 20.1 | 46.3 | 390 |
| HI0551 | 569189 | 570049 | rRNA (adenosine-N6,N6-)-dimethyltransferase (ksgA) (*Escherichia coli*) | 69.3 | 81.5 | 269 |
| HI0513 | 527345 | 526362 | tellurrie resistance protein (tehA) (*Escherichia coli*) | 38.9 | 62.0 | 317 |
| HI1278 | 1351140 | 1350283 | tellurrie resistance protein (tehB) (*Escherichia coli*) | 55.2 | 70.6 | 194 |

Radiation sensitivity

| ID | Start | End | Description | % | % | Len |
|---|---|---|---|---|---|---|
| HI0954 | 1011412 | 1010711 | radC protein (radC) (*Escherichia coli*) | 49.8 | 71.7 | 219 |

-continued

Adaptations, atypical conditions

| | | | | | | |
|---|---|---|---|---|---|---|
| HI1532 | 1596570 | 1595143 | autotrophic growth protein (aut) (*Alcaligenes autrophus*) | 45.0 | 50.9 | 154 |
| HI0722 | 766921 | 767769 | heat shock protein (htpX) (*Escherichia coli*) | 66.3 | 82.1 | 288 |
| HI1533 | 1596655 | 1597599 | heat shock protein B (ibpB) (*Escherichia coli*) | 55.9 | 71.2 | 304 |
| HI0947 | 1003887 | 1004906 | htrA-like protein (htrA) (*Escherichia coli*) | 55.2 | 72.6 | 262 |
| HI0903 | 956705 | 957292 | invasion protein (invA) (*Bartonella bacilliformis*) 39.5 | | 60.5 | 187 |
| HI1550 | 1615090 | 1614485 | NAD(P)H:menadione oxidoreductase (*Nus musculus*) | 35.9 | 54.9 | 200 |
| HI0460 | 479443 | 478505 | survival protein (surA) (*Escherichia coli*) | 33.0 | 58.5 | 424 |
| HI0617 | 866160 | 865738 | uspA protein (uspA) (*Escherichia coli*) | 68.6 | 87.1 | 140 |
| HI0323 | 350541 | 350774 | virulence plasmid protein (vagC) (*Salmonella dublin*) | 35.9 | 57.8 | 62 |
| HI1254 | 1326770 | 1327090 | virulence associated protein A (vapA) (*Dichelobacter nodosus*) | 40.8 | 57.7 | 71 |
| HI0324 | 350774 | 351175 | virulence associated protein C (vapC) (*Dichelobacter nodosus*) | 35.4 | 56.9 | 128 |
| HI0949 | 1007984 | 1007589 | virulence associated protein C (vapC) (*Dichelobacter nodosus*) | 40.9 | 60.6 | 131 |
| HI0452 | 472751 | 472479 | virulence associated protein D (vapD) (*Dichelobacter nodosus*) | 40.7 | 67.0 | 91 |
| HI1310 | 1385051 | 1385680 | virulence plasmid protein (migA) (*Shewanella colwalliana*) | 23.8 | 56.3 | 124 |

Undetermined

| | | | | | | |
|---|---|---|---|---|---|---|
| HI1164 | 1230321 | 1229906 | 15 kDs protein (P15) (*Escherichia coli*) | 49.3 | 68.4 | 136 |
| HI0085 | 89585 | 88593 | 2-hydroxyaciddehydrogenases homolog (ddh) (*Zymomorias mobilis*) | 51.5 | 72.8 | 324 |
| HI0462 | 480185 | 480973 | beta-lactamase regulatory homolog (mazG) (*Escherichia coli*) | 48.3 | 72.6 | 257 |
| HI1576 | 1738223 | 1737753 | conjugative transfer co-repressor (tinO) (*Escherichia coli*) | 32.5 | 51.9 | 76 |
| HI0309 | 340851 | 340591 | delta-I-pyrroline-5-carboxylate reductase (proC) (*Pseudomonas aeruginosa*) | 44.0 | 60.1 | 267 |
| HI1555 | 1620490 | 1619810 | devA protein (devA) (*Anabaena* sp.) | 42.7 | 66.4 | 219 |
| HI0558 | 576002 | 575514 | devB protein (devB) (*Anabaena* sp.) | 32.7 | 51.5 | 156 |
| HI1342 | 1415087 | 1415473 | embryonic abundant protein, group 3 (*Triticum aestivum*) | 33.3 | 50.0 | 102 |
| HI0939 | 996457 | 996658 | extragenic supressor (suhB) (*Escherichia coli*) | 64.7 | 80.2 | 258 |
| HI0370 | 390960 | 392063 | GCPE protein (protein E) (ppcE) (*Escherichia coli*) | 88.2 | 93.9 | 362 |
| HI0095 | 102616 | 101864 | GerC2 protein (gerC2) (*Bacillus subtilis*) | 32.9 | 55.2 | 191 |
| HI0689 | 712892 | 711894 | glpX protein (glpX) (*Escherichia coli*) | 69.2 | 83.4 | 325 |
| HI1015 | 1076616 | 1077389 | glyoxylate-induced protein (*Escherichia coli*) | 39.1 | 57.8 | 258 |
| HI0499 | 511702 | 513099 | halU protein (halU) (*Escherichia coli*) | 80.4 | 90.1 | 443 |
| HI0498 | 511230 | 511754 | halV protein (halV) (*Escherichia coli*) | 79.8 | 89.0 | 172 |
| HI1120 | 1184041 | 1182516 | ilv-related protein (*Escherichia coli*) | 59.7 | 77.0 | 504 |
| HI0287 | 319073 | 317784 | isochorismate synthase (entC) (*Bacillus subtilis*) | 31.5 | 48.9 | 311 |
| HI1624 | 1666217 | 1665567 | membrane associated ATPase (cbrO) (*Propionibacterium freudenreichi*) | 33.7 | 52.7 | 184 |
| HI0463 | 481901 | 481029 | membrane protein (lapB) (*Pasteurella haemolytica*) | 34.2 | 556.0 | 221 |
| HI1122 | 1184867 | 1185742 | membrane protein (lapB) (*Pasteurella haemolytica*) | 63.1 | 80.2 | 216 |
| HI0590 | 608642 | 609874 | N-carbamyl-L-amino acid amidohydrolase (*Bacillus stearothemophilus*) | 35.9 | 59.2 | 406 |
| HI0380 | 399796 | 398579 | nitrogen fixation protein (nifS) (*Anabaena* sp.) | 48.2 | 67.0 | 679 |
| HI1296 | 1375045 | 1373735 | nitrogen fixation protein (nifS) (*Mycobacterium leprae*) | 33.4 | 56.2 | 402 |
| HI1346 | 1418236 | 1417523 | nitrogen fixation protein (nifS) (*Mycobacterium leprae*) | 36.8 | 58.5 | 186 |
| HI0379 | 398591 | 398139 | nitrogen fixation protein (nifU) (*Klebsiella pneumoniae*) | 50.8 | 74.2 | 122 |
| HI0167 | 180354 | 181565 | nitrogen fixation protein (rnfE) (*Rhodobacter capsulatus*) | 30.1 | 47.9 | 292 |
| HI1692 | 1756087 | 1757180 | nitrogen fixation protein (rnfE) (*Rhodobacter capsulatus*) | 32.7 | 59.5 | 290 |
| HI0129 | 143015 | 144800 | nitrogenase C (nitC) (*Clostridium pasteunanum*) | 27.1 | 52.6 | 248 |
| HI1480 | 1559124 | 1558768 | nitrogenase C (nitC) (*Clostridium pasteunanum*) | 40.9 | 60.2 | 92 |
| HI0359 | 381523 | 382464 | nmtl protein (nmtl) (*Aspergileus parasiticus*) | 25.6 | 54.7 | 289 |
| HI1299 | 1375415 | 1374882 | partitioning system protein (parB) (Plasmid RP4) | 43.6 | 67.7 | 141 |
| HI0224 | 252941 | 252168 | rarD protein (rarD) (*Escherichia coli*) | 26.5 | 53.0 | 230 |
| HI0682 | 721733 | 720840 | rarD protein (rarD) (*Escherichia coli*) | 27.1 | 55.0 | 289 |
| HI0918 | 970839 | 970249 | skp protein (skp) (*Pasteurella multocida*) | 55.5 | 76.4 | 191 |
| HI0983 | 1038375 | 1037593 | small protein (ampB) (*Escherichia coli*) | 78.8 | 91.3 | 180 |
| HI1598 | 1661488 | 1659882 | spolllE protein (spolllE) (*Coxiella burneta*) | 56.1 | 74.5 | 504 |
| HI0898 | 951407 | 952018 | suppressor protein (msgA) (*Escherichia coli*) | 30.2 | 56.1 | 254 |
| HI1080 | 1145382 | 1144612 | surfactin (afpo) (*Bacillus subtilis*) | 58.2 | 77.9 | 246 |
| HI0753 | 811790 | 811296 | toxR regulon (tagD) (*Vibrio cholerae*) | 45.7 | 64.0 | 164 |
| HI1412 | 1502860 | 1501311 | traN protein (traN) (Plasmid RP4) | 40.2 | 61.5 | 233 |
| HI0658 | 708305 | 708960 | transport ATP-binding protein (cydC) (*Escherichia coli*) | 26.3 | 51.7 | 536 |
| HI1159 | 1225137 | 1223410 | transport ATP-binding protein (cydC) (*Escherichia coli*) | 48.5 | 70.1 | 568 |
| HI1582 | 1627239 | 1626295 | vanH protein (vanH) (Transposon Tn1546) | 39.7 | 57.1 | 251 |
| HI0632 | 668489 | 669433 | mucoid status locus protein (mucB) (*Pseudomonas aeruginosa*) | 25.4 | 51.8 | 309 |
| HI0172 | 183553 | 184785 | phenolhydroxylase (ORF6) (*Acinetobacter calcoacaticus*) | 33.0 | 56.9 | 313 |
| HI1390 | 1481177 | 1481266 | plasma protease C1 inhibitor (*Homo sapiens*) | 75.0 | 79.2 | 23 |

KNOWN.before

| | |
|---|---|
| HI0060 | ATP dependent translocator homolog (msbA) |
| HI0140 | outer membrane protein P2 (ompP2) |
| HI0251 | single-stranded DNA binding protein (sab) |
| HI0252 | tonB protein (tonB) |
| HI0266 | heme-hemopexin-binding protein (hxuA) |
| HI0351 | adenylate kinase (ATP-AMP transphosphorylase) (ack) |
| HI0352 | hypothetical protein (SP:P24326) |

KNOWN.before -continued

| | |
|---|---|
| HI0353 | udp-glucose 4-epimerase (galactowaldenase) (galE) |
| HI0354 | hypothetical protein (SP:P24324) |
| HI0383 | PC protein (15kd peptidoglycan-associated outer membrane lipoprotein) (pal) |
| HI0403 | outer membrane protein P1 (ompP1) |
| HI0435 | transformation gene cluster hypothetical protein (GB:M62809_10) (com) |
| HI0436 | com 101A protein (comF) |
| HI0437 | transformation gene cluster hypothetical protein (GB:M62809_7) (com) |
| HI0438 | transformation gene cluster hypothetical protein (GB:M62809_6) (com) |
| HI0439 | transformation gene cluster hypothetical protein (GB:M62809_5) (com) |
| HI0440 | transformation gene cluster hypothetical protein (GB:M62809_4) (com) |
| HI0441 | transformation gene cluster hypothetical protein (GB:M62809_3) (com) |
| HI0442 | transformation gene cluster hypothetical protein (GB:M62809_2) (com) |
| HI0443 | transformation gene cluster hypothetical protein (GB:M62809_1) (com) |
| HI0514 | HincII endonuclease (HincII) |
| HI0515 | modification methlyase HincII (hincIIM) |
| HI0552 | lipooligsaccharide biosynthesis protein |
| HI0583 | streptomycin resistance protein (strA) |
| HI0602 | recombinase (recA) |
| HI0603 | tfoX protein (tfoX) |
| HI0606 | adenylate cyclase (cysA) |
| HI0622 | 28 kDa membrane protein (hlpA) |
| HI0691 | protein D (hpd) |
| HI0695 | lipoprotein (hel) |
| HI0820 | aldose 1-epimerase precursor (mutarotase) (mro) |
| HI0821 | galactokinase (galK) |
| HI0822 | galactose-1-phosphate uridylytransferase (galT) |
| HI0823 | galactose operon repressor (galS) |
| HI0847 | hypothetical protein (GB:M94205_1) |
| HI0848 | disulfide oxidoreductase (por) |
| HI0855 | heme-binding lipoprotein (dppA) |
| HI0919 | protective surface antigen D15 |
| HI0930 | KW20 catalase (hktE) |
| HI0959 | cyclic AMP receptor protein (crp) |
| HI1090 | superoxide dismutase (sodA) |
| HI1167 | outer membrane protein P5 (ompA) |
| HI1191 | DNA helicase II (uvrD) |
| HI1397 | HindIII modification methyltransferase (hindIIIM) |
| HI1398 | HindIII restriction endonuclease (hindIIIR) |
| HI1402 | DNA polymerase III, chi subunit (holC) |
| HI1545 | lic-1 operon protein (licC) |
| HI1548 | lic-1 operon protein (licD) |
| HI1585 | 15 kd peptidoglycan-associated lipoprotein (lpp) |
| HI1594 | formyltetrahydrofolate hydrolase (purU) |
| HI1595 | enolpyruvylshikimatephosphatesynthase (aroA) |
| HI1699 | lag locus hypothetical protein (GB:M94855_8) |
| HI1700 | lag locus hypothetical protein (GB:M94855_7) |
| HI1701 | lag locus hypothetical protein (GB:M94855_6) |
| HI1702 | lag locus hypothetical protein (GB:M94855_5) |
| HI1703 | lag locus hypothetical protein (GB:M94855_4) |
| HI1704 | lag locus hypothetical protein (GB:M94855_3) |
| HI1705 | lag locus hypothetical protein (GB:M94855_2) |
| HI1706 | lag locus hypothetical protein (GB:M94855_1) |

UNKNOWNS

| | | |
|---|---|---|
| HI0003 | 3249 | 2464 |
| HI0004 | 3729 | 3268 |
| HI0012 | 11778 | 12767 |
| HI0017 | 17829 | 17449 |
| HI0019 | 20239 | 18819 |
| HI0021 | 23349 | 22102 |
| HI0028 | 29582 | 29307 |
| HI0033 | 35298 | 34834 |
| HI0034 | 35660 | 35355 |
| HI0035 | 37440 | 35788 |
| HI0040 | 43059 | 42286 |
| HI0042 | 44594 | 43923 |
| HI0043 | 45858 | 44597 |
| HI0044 | 46386 | 45721 |
| HI0045 | 47261 | 46710 |
| HI0046 | 47328 | 47687 |
| HI0050 | 51426 | 50224 |
| HI0051 | 51998 | 51504 |
| HI0052 | 53023 | 52040 |
| HI0053 | 54078 | 53053 |
| HI0056 | 56966 | 56256 |
| HI0059 | 60728 | 59733 |
| HI0065 | 67839 | 68312 |
| HI0072 | 78167 | 77313 |
| HI0073 | 79220 | 78879 |
| HI0074 | 79653 | 79216 |
| HI0077 | 83046 | 83909 |
| HI0080 | 85983 | 86411 |
| HI0081 | 86556 | 87341 |
| HI0082 | 87601 | 87864 |
| HI0083 | 87882 | 88094 |
| HI0090 | 96604 | 97314 |

-continued

| UNKNOWNS | | |
|---|---|---|
| HI0091 | 96493 | 97360 |
| HI0092 | 99761 | 98505 |
| HI0093 | 100989 | 99886 |
| HI0094 | 101511 | 101194 |
| HI0096 | 102950 | 103522 |
| HI0100 | 107807 | 107415 |
| HI0101 | 108091 | 107654 |
| HI0103 | 109598 | 109257 |
| HI0105 | 111789 | 112625 |
| HI0107 | 114405 | 115612 |
| HI0108 | 115744 | 116634 |
| HI0109 | 117067 | 116729 |
| HI0112 | 119485 | 119847 |
| HI0114 | 122424 | 122311 |
| HI0115 | 128606 | 130242 |
| HI0116 | 130860 | 130246 |
| HI0117 | 131552 | 131800 |
| HI0120 | 134883 | 134380 |
| HI0121 | 138357 | 134999 |
| HI0125 | 140096 | 141409 |
| HI0126 | 142556 | 141573 |
| HI0127 | 142955 | 143011 |
| HI0128 | 142716 | 142584 |
| HI0130 | 145160 | 144804 |
| HI0131 | 145840 | 145136 |
| HI0134 | 147247 | 148419 |
| HI0135 | 148422 | 149609 |
| HI0136 | 151208 | 149695 |
| HI0144 | 159021 | 158125 |
| HI0146 | 160156 | 159932 |
| HI0147 | 160966 | 161952 |
| HI0148 | 161966 | 163664 |
| HI0149 | 164031 | 165167 |
| HI0150 | 165574 | 165762 |
| HI0153 | 168744 | 168040 |
| HI0160 | 174988 | 174467 |
| HI0163 | 178311 | 177715 |
| HI0165 | 179007 | 180080 |
| HI0166 | 180130 | 180348 |
| HI0168 | 181582 | 182313 |
| HI0169 | 182316 | 182567 |
| HI0I70 | 182570 | 182938 |
| HI0I71 | 182945 | 183537 |
| HI0173 | 184932 | 185969 |
| HI0174 | 185975 | 186232 |
| HI0175 | 186247 | 187500 |
| HI0176 | 188281 | 187550 |
| HI0177 | 189257 | 188286 |
| HI0178 | 189385 | 190150 |
| HI0179 | 190715 | 190236 |
| HI0183 | 195295 | 196233 |
| HI0184 | 196413 | 197855 |
| HI0185 | 198872 | 198048 |
| HI0188 | 200705 | 201555 |
| HI0189 | 201568 | 202335 |
| HI0196 | 208646 | 206611 |
| HI0199 | 213460 | 214224 |
| HI0204 | 218138 | 217605 |
| HI0206 | 218715 | 219485 |
| HI0211 | 225095 | 225199 |
| HI0218 | 234170 | 234697 |
| HI0220 | 238722 | 238084 |
| HI0228 | 256953 | 256489 |
| HI0229 | 257403 | 257032 |
| HI0231 | 259913 | 260654 |
| HI0233 | 262997 | 264382 |
| HI0234 | 264390 | 264539 |
| HI0235 | 264822 | 264679 |
| HI0236 | 265239 | 265033 |
| HI0238 | 265736 | 266389 |
| HI0239 | 266350 | 266781 |
| HI0243 | 270426 | 270208 |
| HI0244 | 270941 | 270426 |
| HI0247 | 274159 | 273716 |
| HI0257 | 285979 | 286623 |
| HI0258 | 286796 | 286879 |
| HI0259 | 286880 | 288054 |

-continued

| UNKNOWNS | | |
|---|---|---|
| HI0260 | 288240 | 288058 |
| HI0261 | 288839 | 288180 |
| HI0262 | 289503 | 288919 |
| HI0267 | 298808 | 298450 |
| HI0268 | 298891 | 299487 |
| HI0272 | 304213 | 303284 |
| HI0273 | 305079 | 304216 |
| HI0277 | 309032 | 310684 |
| HI0278 | 311516 | 310710 |
| HI0279 | 311998 | 311516 |
| HI0280 | 312417 | 312004 |
| HI0281 | 312664 | 312371 |
| HI0283 | 315199 | 312886 |
| HI0284 | 315200 | 316061 |
| HI0286 | 318836 | 319252 |
| HI0293 | 327115 | 326912 |
| HI0295 | 327473 | 327856 |
| HI0301 | 333498 | 333052 |
| HI0305 | 337302 | 338036 |
| HI0306 | 338038 | 338593 |
| HI0307 | 338596 | 339012 |
| HI0308 | 339973 | 339068 |
| HI0310 | 340854 | 342017 |
| HI0312 | 343117 | 343401 |
| HI0313 | 343271 | 343092 |
| HI0317 | 346507 | 345770 |
| HI0318 | 347143 | 346670 |
| HI0320 | 349180 | 349665 |
| HI0321 | 349721 | 350002 |
| HI0322 | 349996 | 350444 |
| HI0325 | 351245 | 351649 |
| HI0327 | 352729 | 354078 |
| HI0328 | 354114 | 354374 |
| HI0329 | 354653 | 354697 |
| HI0331 | 355655 | 356688 |
| HI0335 | 359242 | 360555 |
| HI0338 | 363320 | 363910 |
| HI0340 | 364253 | 365296 |
| HI0342 | 367615 | 368352 |
| HI0343 | 368440 | 368781 |
| HI0344 | 368990 | 369516 |
| HI0345 | 369512 | 369790 |
| HI0346 | 369815 | 372311 |
| HI0347 | 372389 | 373205 |
| HI0348 | 373208 | 374068 |
| HI0349 | 374068 | 374517 |
| HI0352 | 377303 | 376029 |
| HI0354 | 379329 | 376637 |
| HI0355 | 379330 | 380044 |
| HI0357 | 380765 | 381167 |
| HI0358 | 381227 | 381171 |
| HI0361 | 384039 | 383227 |
| HI0365 | 386932 | 387009 |
| HI0366 | 387928 | 387053 |
| HI0367 | 388154 | 389323 |
| HI0368 | 389428 | 389964 |
| HI0369 | 390039 | 390947 |
| HI0372 | 393384 | 393975 |
| HI0373 | 394223 | 394032 |
| HI0376 | 397168 | 396485 |
| HI0377 | 397743 | 397222 |
| HI0378 | 398079 | 397759 |
| HI0381 | 400309 | 399860 |
| HI0382 | 401087 | 400365 |
| HI0388 | 406077 | 405670 |
| HI0390 | 408337 | 409044 |
| HI0391 | 409072 | 409620 |
| HI0393 | 413144 | 412599 |
| HI0394 | 414371 | 413637 |
| HI0395 | 415645 | 414557 |
| HI0397 | 416445 | 416750 |
| HI0398 | 416758 | 417967 |
| HI0400 | 419468 | 420118 |
| HI0402 | 421340 | 421056 |
| HI0406 | 425499 | 424210 |
| HI0407 | 426365 | 425502 |
| HI0414 | 433167 | 432202 |

-continued

| UNKNOWNS | | |
|---|---|---|
| HI0417 | 437163 | 437957 |
| HI0418 | 437953 | 438759 |
| HI0419 | 438773 | 439450 |
| HI0420 | 439396 | 440738 |
| HI0422 | 442434 | 442730 |
| HI0423 | 443077 | 442916 |
| HI0425 | 444797 | 445516 |
| HI0426 | 446607 | 445555 |
| HI0433 | 454103 | 453516 |
| HI0434 | 454932 | 454142 |
| HI0444 | 463691 | 464053 |
| HI0451 | 472389 | 471856 |
| HI0453 | 472951 | 472763 |
| HI0454 | 474321 | 473026 |
| HI0455 | 474896 | 474375 |
| HI0456 | 475705 | 474926 |
| HI0458 | 477453 | 476743 |
| HI0466 | 485905 | 486561 |
| HI0468 | 488712 | 487873 |
| HI0469 | 489585 | 488725 |
| HI0471 | 491037 | 492317 |
| HI0478 | 497647 | 497796 |
| HI0489 | 507333 | 506959 |
| HI0490 | 507449 | 508048 |
| HI0491 | 508051 | 508521 |
| HI0492 | 508274 | 508038 |
| HI0493 | 508854 | 509354 |
| HI0494 | 509815 | 509856 |
| HI0495 | 509856 | 510253 |
| HI0496 | 510797 | 510306 |
| HI0497 | 511011 | 510814 |
| HI0502 | 516228 | 517265 |
| HI0509 | 523382 | 523930 |
| HI0510 | 524561 | 524076 |
| HI0511 | 525540 | 524816 |
| HI0512 | 525587 | 526303 |
| HI0521 | 542216 | 540966 |
| HI0522 | 543103 | 542318 |
| HI0523 | 544656 | 543115 |
| HI0524 | 544869 | 545522 |
| HI0525 | 546551 | 545484 |
| HI0528 | 549859 | 549044 |
| HI0554 | 571956 | 572576 |
| HI0556 | 575147 | 574608 |
| HI0557 | 575547 | 575211 |
| HI0559 | 576210 | 576091 |
| HI0562 | 578540 | 580381 |
| HI0563 | 581038 | 580382 |
| HI0564 | 581352 | 581744 |
| HI0567 | 584110 | 583439 |
| HI0570 | 587757 | 587551 |
| HI0572 | 591096 | 590482 |
| HI0574 | 592124 | 592846 |
| HI0576 | 593256 | 593978 |
| HI0577 | 594070 | 594732 |
| HI0578 | 594735 | 595112 |
| HI0579 | 595480 | 595764 |
| HI0587 | 607340 | 606504 |
| HI0588 | 607798 | 607361 |
| HI0591 | 610092 | 610508 |
| HI0594 | 614632 | 614441 |
| HI0595 | 616566 | 616775 |
| HI0596 | 616702 | 615176 |
| HI0599 | 619155 | 619970 |
| HI0600 | 620322 | 619999 |
| HI0619 | 650498 | 651154 |
| HI0626 | 663588 | 664921 |
| HI0628 | 666387 | 666770 |
| HI0629 | 666863 | 667117 |
| HI0635 | 672600 | 672893 |
| HI0636 | 672899 | 673879 |
| HI0638 | 677932 | 677545 |
| HI0640 | 679087 | 679701 |
| HI0649 | 691619 | 690906 |
| HI0652 | 694996 | 694787 |
| HI0655 | 696806 | 697567 |
| HI0658 | 699494 | 698946 |

-continued

| UNKNOWNS | | |
|---|---|---|
| HI0660 | 701972 | 700059 |
| HI0661 | 702429 | 702136 |
| HI0663 | 702781 | 702425 |
| HI0664 | 706058 | 705867 |
| HI0667 | 711078 | 710050 |
| HI0668 | 711395 | 711078 |
| HI0670 | 713054 | 713269 |
| HI0672 | 713806 | 714236 |
| HI0673 | 715017 | 714544 |
| HI0674 | 715691 | 714544 |
| HI0675 | 715969 | 715694 |
| HI0679 | 719498 | 719061 |
| HI0689 | 731017 | 731928 |
| HI0690 | 732026 | 732334 |
| HI0696 | 737789 | 738508 |
| HI0698 | 743511 | 739619 |
| HI0699 | 744964 | 743524 |
| HI0700 | 745259 | 744239 |
| HI0702 | 746523 | 746065 |
| HI0703 | 746632 | 747648 |
| HI0704 | 747649 | 748418 |
| HI0706 | 749008 | 749188 |
| HI0708 | 749180 | 749148 |
| HI0720 | 765555 | 766304 |
| HI0721 | 766361 | 766750 |
| HI0723 | 768095 | 767817 |
| HI0725 | 768792 | 770060 |
| HI0726 | 776311 | 776868 |
| HI0727 | 776875 | 777312 |
| HI0732 | 786122 | 783778 |
| HI0733 | 786625 | 786245 |
| HI0734 | 786731 | 786582 |
| HI0735 | 787647 | 786715 |
| HI0737 | 788457 | 789167 |
| HI0742 | 799457 | 800908 |
| HI0743 | 801060 | 801386 |
| HI0744 | 801027 | 800965 |
| HI0746 | 802425 | 801982 |
| HI0755 | 816503 | 817618 |
| HI0757 | 819456 | 818531 |
| HI0758 | 820676 | 819447 |
| HI0762 | 823117 | 823388 |
| HI0763 | 823404 | 824474 |
| HIC764 | 825768 | 825091 |
| HI0768 | 829290 | 828811 |
| HI0769 | 829882 | 829304 |
| HI0774 | 835432 | 834092 |
| H10775 | 836100 | 835432 |
| HI0777 | 836970 | 837914 |
| HI0789 | 843493 | 844095 |
| HI0808 | 854572 | 855375 |
| HI0809 | 856603 | 855413 |
| HI0812 | 860092 | 859214 |
| HI0819 | 868114 | 867569 |
| HI0827 | 876702 | 877433 |
| HI0828 | 877442 | 877996 |
| HI0829 | 877999 | 878480 |
| HI0833 | 881059 | 881640 |
| HI0839 | 887221 | 886541 |
| HI0840 | 887844 | 887278 |
| HI0841 | 888779 | 887757 |
| HI0842 | 888896 | 889111 |
| HI0843 | 889116 | 890870 |
| HI0844 | 891071 | 891898 |
| HI0845 | 891925 | 892059 |
| HI0847 | 892866 | 893129 |
| HI0849 | 893822 | 894164 |
| HI0851 | 895374 | 896144 |
| HI0852 | 896141 | 896572 |
| HI0853 | 896977 | 897510 |
| HI0854 | 897510 | 898898 |
| HI0856 | 900867 | 901625 |
| HI0857 | 902112 | 901768 |
| HI0859 | 905088 | 905367 |
| HI0860 | 905688 | 906248 |
| HI0862 | 909728 | 908989 |
| HI0863 | 912130 | 909785 |

-continued

| UNKNOWNS | | |
|---|---|---|
| HI0864 | 912029 | 912325 |
| HI0866 | 915792 | 913945 |
| HI0868 | 918419 | 918538 |
| HI0871 | 920692 | 921248 |
| HI0872 | 921338 | 921439 |
| HI0873 | 922696 | 923613 |
| HI0876 | 927351 | 926155 |
| HI0880 | 931427 | 930509 |
| HI0883 | 932310 | 933296 |
| HI0884 | 933350 | 934084 |
| HI0888 | 938667 | 939088 |
| HI0892 | 943890 | 944319 |
| HI0893 | 944315 | 944518 |
| HI0904 | 957295 | 958086 |
| HI0905 | 957488 | 957174 |
| HI0908 | 959765 | 960283 |
| HI0909 | 960628 | 960317 |
| HI0910 | 960708 | 961007 |
| HI0914 | 966380 | 967141 |
| HI0920 | 974685 | 973357 |
| HI0922 | 976298 | 975582 |
| HI0927 | 983767 | 983405 |
| HI0928 | 984057 | 983800 |
| HI0931 | 988229 | 987051 |
| HI0932 | 988650 | 988233 |
| HI0933 | 989308 | 988826 |
| HI0935 | 991961 | 990760 |
| HI0936 | 993112 | 991961 |
| HI0937 | 993639 | 993112 |
| HI0938 | 995848 | 993642 |
| HI0940 | 996553 | 997110 |
| HI0941 | 997170 | 997883 |
| HI0942 | 997888 | 998566 |
| HI0943 | 998544 | 998846 |
| HI0945 | 1002315 | 1002762 |
| HI0950 | 1008217 | 1007887 |
| HI0957 | 1013248 | 1013899 |
| HI0958 | 1013924 | 1014091 |
| HI0860 | 1016378 | 1015203 |
| HI0861 | 1017426 | 1016374 |
| HI0862 | 1017780 | 1017433 |
| HI0863 | 1018172 | 1017783 |
| HI0865 | 1022036 | 1021104 |
| HI0866 | 1023806 | 1022077 |
| HI0867 | 1023983 | 1024175 |
| HI0868 | 1024843 | 1024944 |
| HI0869 | 1024817 | 1024254 |
| HI0876 | 1030808 | 1031712 |
| HI0878 | 1033994 | 1034883 |
| HI0879 | 1034889 | 1035440 |
| HI0881 | 1036523 | 1037512 |
| HI0886 | 1041067 | 1040252 |
| HI0888 | 1042709 | 1044301 |
| HI0890 | 1045812 | 1047047 |
| HI0898 | 1061807 | 1062044 |
| HI0899 | 1062383 | 1063049 |
| HI1002 | 1063710 | 1063987 |
| HI1003 | 1063970 | 1065592 |
| HI1005 | 1067238 | 1067478 |
| HI1006 | 1067384 | 1069165 |
| HI1007 | 1069256 | 1070812 |
| HI1009 | 1071385 | 1072339 |
| HI1012 | 1073835 | 1074737 |
| HI1013 | 1074743 | 1075961 |
| HI1016 | 1077448 | 1078392 |
| HI1018 | 1079980 | 1080315 |
| HI1021 | 1082175 | 1083170 |
| HI1022 | 1083178 | 1084791 |
| HI1023 | 1084738 | 1085422 |
| HI1026 | 1089488 | 1088792 |
| HI1028 | 1091055 | 1090208 |
| HI1029 | 1091088 | 1092257 |
| HI1030 | 1093581 | 1092598 |
| HI1031 | 1094889 | 1093515 |
| HI1032 | 1095371 | 1094889 |
| HI1033 | 1096441 | 1095446 |
| HI1034 | 1096517 | 1097420 |

-continued

| UNKNOWNS | | |
|---|---|---|
| HI1036 | 1098535 | 1099023 |
| HI1038 | 1100258 | 1100810 |
| HI1039 | 1101878 | 1100997 |
| HI1040 | 1102257 | 1103456 |
| HI1041 | 1103535 | 1103386 |
| HI1045 | 1108332 | 1107835 |
| HI1046 | 1108943 | 1108335 |
| HI1050 | 1113190 | 1114304 |
| HI1055 | 1117964 | 1118322 |
| HI1056 | 1119807 | 1118428 |
| HI1057 | 1121238 | 1119698 |
| HI1058 | 1123210 | 1123287 |
| HI1060 | 1123448 | 1122668 |
| HI1065 | 1127038 | 1126827 |
| HI1066 | 1128454 | 1127000 |
| HI1072 | 1135048 | 1133604 |
| HI1073 | 1135234 | 1134995 |
| HI1074 | 1137513 | 1135257 |
| HI1075 | 1137884 | 1137513 |
| HI1076 | 1138337 | 1137888 |
| HI1084 | 1148702 | 1148448 |
| HI1085 | 1149040 | 1148726 |
| HI1086 | 1149665 | 1149054 |
| HI1087 | 1150228 | 1149728 |
| HI1088 | 1151024 | 1150242 |
| HI1091 | 1153141 | 1153776 |
| HI1092 | 1153784 | 1154446 |
| HI1093 | 1154507 | 1155244 |
| HI1094 | 1155289 | 1155489 |
| HI1095 | 1155489 | 1158007 |
| HI1096 | 1156007 | 1157950 |
| HI1097 | 1158092 | 1158634 |
| HI1098 | 1158637 | 1160013 |
| HI1099 | 1160451 | 1160492 |
| HI1100 | 1160501 | 1160632 |
| HI1101 | 1160637 | 1160942 |
| HI1103 | 1164060 | 1163077 |
| HI1107 | 1166804 | 1168024 |
| HI1121 | 1184774 | 1184115 |
| HI1128 | 1191629 | 1192577 |
| HI1129 | 1193461 | 1193234 |
| HI1131 | 1195069 | 1195242 |
| HI1132 | 1195447 | 1195899 |
| HI1133 | 1195933 | 1196895 |
| HI1149 | 1215838 | 1214972 |
| HI1150 | 1216338 | 1215847 |
| HI1151 | 1217066 | 1216344 |
| HI1152 | 1217588 | 1217073 |
| HI1153 | 1218198 | 1217572 |
| HI1154 | 1218770 | 1218237 |
| HI1156 | 1220425 | 1220951 |
| HI1158 | 1223159 | 1222595 |
| HI1165 | 1231243 | 1230773 |
| HI1168 | 1235872 | 1236231 |
| HI1171 | 1238778 | 1239119 |
| HI1172 | 1239729 | 1239166 |
| HI1176 | 1242816 | 1243383 |
| HI1178 | 1244125 | 1244051 |
| HI1179 | 1244360 | 1244142 |
| HI1184 | 1246098 | 1247517 |
| HI1185 | 1248305 | 1248859 |
| HI1186 | 1248934 | 1249107 |
| HI1193 | 1256974 | 1256552 |
| HI1194 | 1257654 | 1257067 |
| HI1195 | 1257810 | 1257950 |
| HI1198 | 1260250 | 1261479 |
| HI1201 | 1263689 | 1264309 |
| HI1202 | 1264360 | 1265430 |
| HI1205 | 1267550 | 1268050 |
| HI1206 | 1270263 | 1268131 |
| HI1208 | 1271751 | 1272191 |
| HI1218 | 1282515 | 1283219 |
| HI1219 | 1283219 | 1283904 |
| HI1225 | 1291759 | 1292049 |
| HI1226 | 1292052 | 1293239 |
| HI1237 | 1306218 | 1306673 |
| HI1238 | 1307299 | 1306835 |

-continued

| UNKNOWNS | | |
|---|---|---|
| HI1239 | 1308273 | 1307173 |
| HI1243 | 1313696 | 1313037 |
| HI1244 | 1313794 | 1314591 |
| HI1246 | 1318522 | 1315827 |
| HI1247 | 1317233 | 1318616 |
| HI1249 | 1319911 | 1321851 |
| HI1151 | 1325506 | 1324541 |
| HI1252 | 1326129 | 1325512 |
| HI1253 | 1326454 | 1326758 |
| HI1255 | 1327256 | 1328923 |
| HI1255 | 1328946 | 1329326 |
| HI1257 | 1329334 | 1330392 |
| HI1258 | 1330818 | 1330839 |
| HI1259 | 1330839 | 1331300 |
| HI1260 | 1331300 | 1331470 |
| HI1265 | 1339879 | 1339148 |
| HI1268 | 1346269 | 1345733 |
| HI1269 | 1346269 | 1346836 |
| HI1270 | 1348824 | 1346241 |
| HI1271 | 1348849 | 1347025 |
| HI1272 | 1347022 | 1347135 |
| HI1273 | 1347135 | 1347323 |
| HI1276 | 1348850 | 1349453 |
| HI1283 | 1356439 | 1356654 |
| HI1284 | 1356655 | 1357185 |
| HI1285 | 1355080 | 1358502 |
| HI1289 | 1367227 | 1365851 |
| HI1291 | 1369084 | 1369447 |
| HI1292 | 1369450 | 1370385 |
| HI1294 | 1372453 | 1371617 |
| HI1295 | 1373365 | 1372583 |
| HI1296 | 1373601 | 1373359 |
| HI1297 | 1373735 | 1373532 |
| HI1300 | 1375530 | 1375949 |
| HI1301 | 1375971 | 1376663 |
| HI1303 | 1379236 | 1380176 |
| HI1304 | 1380896 | 1380210 |
| HI1309 | 1384563 | 1385051 |
| HI1312 | 1386755 | 1386510 |
| HI1313 | 1386780 | 1387538 |
| HI1317 | 1391445 | 1391927 |
| HI1318 | 1392096 | 1392410 |
| HI1319 | 1392802 | 1393383 |
| HI1320 | 1393468 | 1394280 |
| HI1326 | 1401970 | 1401527 |
| HI1329 | 1404808 | 1405533 |
| HI1330 | 1405533 | 1405067 |
| HI1335 | 1409063 | 1405968 |
| HI1336 | 1409263 | 1408968 |
| HI1340 | 1412995 | 1414329 |
| HI1341 | 1414391 | 1414882 |
| HI1343 | 1416879 | 1415557 |
| HI1344 | 1417517 | 1417009 |
| HI1345 | 1418133 | 1419509 |
| HI1352 | 1426118 | 1425637 |
| HI1354 | 1428276 | 1427314 |
| HI1358 | 1433535 | 1433996 |
| HI1367 | 1450229 | 1449365 |
| HI1369 | 1453591 | 1453010 |
| HI1371 | 1458706 | 1455929 |
| HI1372 | 1461329 | 1458813 |
| HI1378 | 1469827 | 1470732 |
| HI1379 | 1470738 | 1471610 |
| HI1391 | 1481365 | 1481808 |
| HI1394 | 1484556 | 1485584 |
| HI1399 | 1492391 | 1482023 |
| HI1400 | 1493035 | 1492616 |
| HI1401 | 1493171 | 1493004 |
| HI1404 | 1495447 | 1498052 |
| HI1405 | 1496978 | 1498157 |
| HI1407 | 1498433 | 1498230 |
| HI1408 | 1499014 | 1498489 |
| HI1409 | 1499168 | 1499050 |
| HI1410 | 1500612 | 1499515 |
| HI1411 | 1501028 | 1500676 |
| HI1413 | 1503610 | 1504026 |
| HI1414 | 1504094 | 1502787 |

-continued

| UNKNOWNS | | |
|---|---|---|
| HI1415 | 1505280 | 1504099 |
| HI1417 | 1506471 | 1505953 |
| HI1418 | 1506880 | 1506602 |
| HI1419 | 1507067 | 1506795 |
| HI1421 | 1507987 | 1507834 |
| HI1422 | 1506392 | 1508327 |
| HI1423 | 1509030 | 1508428 |
| HI1424 | 1509352 | 1509648 |
| HI1425 | 1509648 | 1509938 |
| HI1426 | 1510250 | 1509975 |
| HI1427 | 1510403 | 1510975 |
| HI1428 | 1511264 | 1511545 |
| HI1431 | 1513776 | 1514795 |
| HI1432 | 1514998 | 1515831 |
| HI1439 | 1521750 | 1522223 |
| HI1440 | 1522224 | 1525568 |
| HI1441 | 1525569 | 1525820 |
| HI1443 | 1526752 | 1528626 |
| HI1450 | 1533358 | 1533038 |
| HI1454 | 1536172 | 1536492 |
| HI1455 | 1536633 | 1536668 |
| HI1456 | 1537150 | 1536568 |
| HI1458 | 1538541 | 1537903 |
| HI1460 | 1540315 | 1539812 |
| HI1462 | 1541101 | 1541340 |
| HI1468 | 1547394 | 1546060 |
| HI1474 | 1554422 | 1554078 |
| HI1477 | 1557241 | 1556189 |
| HI1481 | 1560071 | 1559355 |
| HI1482 | 1560378 | 1560563 |
| HI1484 | 1562720 | 1562989 |
| HI1486 | 1563395 | 1562928 |
| HI1487 | 1564353 | 1564667 |
| HI1489 | 1565191 | 1565349 |
| HI1490 | 1565824 | 1566042 |
| HI1491 | 1566045 | 1566215 |
| HI1492 | 1566221 | 1566778 |
| HI1494 | 1567509 | 1568060 |
| HI1495 | 1568255 | 1568467 |
| HI1497 | 1568697 | 1569200 |
| HI1498 | 1569285 | 1569566 |
| HI1500 | 1569836 | 1570093 |
| HI1501 | 1570093 | 1570344 |
| HI1502 | 1570465 | 1570689 |
| HI1503 | 1570599 | 1571015 |
| HI1504 | 1571343 | 1571909 |
| HI1505 | 1571912 | 1573435 |
| HI1506 | 1573450 | 1575009 |
| HI1507 | 1575103 | 1576344 |
| HI1510 | 1578223 | 1579146 |
| HI1511 | 1579232 | 1579486 |
| HI1512 | 1579501 | 1579614 |
| HI1513 | 1579620 | 1580042 |
| HI1514 | 1580012 | 1580593 |
| HI1515 | 1580609 | 1580797 |
| HI1516 | 1580800 | 1582260 |
| HI1517 | 1582273 | 1582626 |
| HI1518 | 1582642 | 1583022 |
| HI1519 | 1583106 | 1584996 |
| HI1520 | 1584526 | 1584371 |
| HI1523 | 1587316 | 1587624 |
| HI1524 | 1587664 | 1588209 |
| HI1525 | 1588221 | 1588625 |
| HI1526 | 1588625 | 1589892 |
| HI1527 | 1589781 | 1590284 |
| HI1528 | 1590287 | 1592155 |
| HI1529 | 1592772 | 1593659 |
| HI1530 | 1593826 | 1593975 |
| HI1540 | 1605903 | 1606442 |
| HI1541 | 1606426 | 1607595 |
| HI1542 | 1607568 | 1607912 |
| HI1548 | 1613326 | 1613877 |
| HI1549 | 1614482 | 1613931 |
| HI1551 | 1618455 | 1615214 |
| HI1552 | 1616740 | 1617159 |
| HI1554 | 1619807 | 1618580 |
| HI1558 | 1622639 | 1621995 |

-continued

UNKNOWNS

| | | |
|---|---|---|
| HI1561 | 1626292 | 1625114 |
| HI1564 | 1628971 | 1628171 |
| HI1566 | 1630319 | 1629652 |
| HI1568 | 1631692 | 1631537 |
| HI1569 | 1632481 | 1631948 |
| HI1570 | 1632603 | 1632517 |
| HI1572 | 1633105 | 1633257 |
| HI1575 | 1636870 | 1636721 |
| HI1576 | 1637376 | 1636870 |
| HI1577 | 1637498 | 1637439 |
| HI1586 | 1647922 | 1647857 |
| HI1587 | 1648198 | 1648028 |
| HI1588 | 1649605 | 1648189 |
| HI1592 | 1654749 | 1653193 |
| HI1596 | 1659183 | 1657846 |
| HI1597 | 1659861 | 1659247 |
| HI1599 | 1661805 | 1661453 |
| HI1600 | 1662311 | 1661643 |
| HI1601 | 1662648 | 1662328 |
| HI1604 | 1665779 | 1664724 |
| HI1605 | 1666807 | 1668094 |
| HI1606 | 1667750 | 1668800 |
| HI1607 | 1668067 | 1667793 |
| HI1608 | 1668561 | 1668109 |
| HI1609 | 1668769 | 1669416 |
| HI1611 | 1670802 | 1671410 |
| HI1613 | 1672733 | 1673359 |
| HI1614 | 1673350 | 1674312 |
| HI1618 | 1678655 | 1677464 |
| HI1626 | 1686816 | 1686318 |
| HI1627 | 1687436 | 1686819 |
| HI1628 | 1687921 | 1687439 |
| HI1630 | 1688617 | 1687937 |
| HI1631 | 1689671 | 1689177 |
| HI1632 | 1690500 | 1690647 |
| HI1633 | 1690388 | 1689675 |
| HI1634 | 1690881 | 1691282 |
| HI1637 | 1693111 | 1692542 |
| HI1643 | 1702265 | 1700876 |
| HI1649 | 1707765 | 1708781 |
| HI1653 | 1711962 | 1712854 |
| HI1654 | 1712909 | 1713433 |
| HI1656 | 1715839 | 1716046 |
| HI1657 | 1716442 | 1718767 |
| HI1658 | 1717744 | 1717196 |
| HI1659 | 1718225 | 1717860 |
| HI1660 | 1720257 | 1719409 |
| HI1661 | 1720329 | 1722053 |
| HI1662 | 1722056 | 1722412 |
| HI1663 | 1722425 | 1723010 |
| HI1668 | 1732543 | 1731989 |
| HI1670 | 1733232 | 1732596 |
| HI1671 | 1733482 | 1733283 |
| HI1672 | 1733818 | 1733528 |
| HI1673 | 1735404 | 1733836 |
| HI1675 | 1737711 | 1737588 |
| HI1677 | 1738407 | 1739658 |
| HI1678 | 1739641 | 1742283 |
| HI1683 | 1745073 | 1745741 |
| HI1685 | 1747304 | 1747841 |
| HI1686 | 1750100 | 1747940 |
| HI1687 | 1750833 | 1750177 |
| HI1689 | 1752080 | 1753086 |
| HI1690 | 1753041 | 1753819 |
| HI1693 | 1757163 | 1757783 |
| HI1694 | 1757788 | 1758492 |
| HI1707 | 1770253 | 1770983 |
| HI1709 | 1774757 | 1773684 |
| HI1710 | 1775850 | 1774744 |
| HI1715 | 1782227 | 1781885 |
| HI1716 | 1782482 | 1782345 |
| HI1720 | 1786580 | 1785523 |
| HI1721 | 1788831 | 1787176 |
| HI1723 | 1788842 | 1788747 |
| HI1724 | 1789761 | 1788979 |
| HI1726 | 1792471 | 1793034 |
| HI1727 | 1793205 | 1793862 |
| HI1729 | 1794880 | 1795201 |
| HI1730 | 1795181 | 1795556 |
| HI1736 | 1803407 | 1802481 |
| HI1737 | 1804046 | 1803407 |
| HI1742 | 1813828 | 1813296 |
| HI1743 | 1813980 | 1813634 |
| HI1744 | 1814881 | 1813980 |

TABLE 3

Whole Genome Sequencing Strategy

| Stage | Description |
|---|---|
| Random small insert and large Insert library construction | Randomly sheared genomic DNA on the order of 2 kb and 15–20 kb respectively |
| Library Plating | Verify random nature of library and maximize random selection of small insert and large insert clones for template production |
| High-throughout DNA sequencing | Sequence sufficient number of sequence fragments from both ends for 6X coverage |
| Assembly | Assemble random sequence fragments and identify repeat regions |
| Gap closure | |
| a. Physical gaps | Order all contigs (fingerprints, peptide links, lambda clones, PCR) and provide templates for closure |
| b. Sequence gaps | Complete the genome sequence by primer walking |
| Editing | Visual inspection and resolution of sequence ambiguities, including frameshifts |
| Annotation | Identification and description of all predicted coding regions (putative identifications, starts and stops, role assignments, operons, regulatory regions) |

TABLE 4

The theory of shotgun sequencing follows from the application of the equation for the Poisson distribution $p_1 \approx m^1 c^{m/st}$ where x is the number of occurrences of an event and m is the mean number of occurrences. The numbers below predict the assembly of a 1.9 Mb genome with an average sequence fragment size of 460 bp.

| N | % unsequenced | bp unsequenced | DS Gaps | Avg. Gap Length |
|---|---|---|---|---|
| 250 | 94.44 | 1794304 | 236 | 7600 |
| 500 | 89.18 | 1694487 | 446 | 3800 |
| 1,000 | 79.54 | 1511204 | 795 | 1900 |
| 2,000 | 63.26 | 1201967 | 1265 | 950 |
| 3,000 | 50.32 | 956009 | 1509 | 633 |
| 5,000 | 31.83 | 604785 | 1592 | 380 |
| 10,000 | 10.13 | 192508 | 1013 | 190 |
| 15,000 | 3.23 | 61277 | 484 | 127 |
| 20,000 | 1.03 | 19505 | 205 | 95 |
| 25,000 | 0.33 | 6209 | 82 | 76 |
| 30,000 | 0.10 | 1976 | 31 | 63 |
| 50,000 | 0.00 | 20 | 1 | 38 |

TABLE 5

Summary of features of whole genome sequencing of *H. influenzae* Rd

| Description | Number |
|---|---|
| Double stranded templates | 19,687 |
| Forward sequencing reactions (M13-21 primer) | 19,346 |
| # Successful (%) | 16,240 (84%) |
| Average edited read length | 485 bp |
| Reverse sequencing reactions (M13RP1 primer) | 9297 |
| # Successful (%) | 7,744 (83%) |
| Average edited read length | 444 bp |
| Sequence fragments in random assembly | 24,304 |
| Total # of base pairs | 11,631,485 |
| #of contigs | 140 |
| Physical gas closure | 42 |
| PCR | 37 |
| Southern analysis | 15 |
| Lambda clones | 23 |
| Peptide links | 2 |
| Terminator sequencing reactions* | 3,102 |
| # Successful (%) | 2,024 (65%) |
| Average edited read length | 375 bp |
| Genome Size | 1,830,121 bp |
| # of N's in sequence (%) | 188 (0.01%) |
| Coordinates of proposed origin of replication | 602,483–602,764 |
| G/C content | 38% |
| # of rRNA | 6 |
| rrnA, rrnC, rrnD (spacer region) | 723 bp |
| rrnB, rrnE, rrnF (spacer region) | 478 bp |
| # of tRNA genes identified | 54 |
| Number of Predicted Coding Regions | 1,749 |
| # Unassigned role (%) | 724 (41%) |
| No database match | 384 |
| Match hypothetical proteins | 340 |
| #Assigned role (%) | 1025 (59%) |
| Amino acid metabolism | 71 (6.9%) |
| Fatty acid/phospholipid metabolism | 24 (2.3%) |
| Biosynthesis of cofacters, prosthetic groups, and carriers | 54 (5.3%) |
| Purines, pyrimidines, nucleosides, nucleotides | 54 (5.3%) |
| Central intermediary metabolism | 31 (3.0%) |
| Energy metabolism | 99 (9.7%) |
| Cell envelope | 82 (8.0%) |
| Regulatory functions | 63 (6.1%) |
| Replication | 88 (8.6%) |
| Transcription | 27 (2.5%) |
| Translation | 146 (14.2%) |
| Transport/binding proteins | 145 (14.1%) |
| Cellular processes | 42 (4.1%) |
| Other | 99 (9.7%) |

*Includes gap closure, walks on rRNA repeats, and random end-sequencing of lambda clones for assembly confirmation

TABLE 6

Two component systems in *H. influenzae* Rd

| ID | Location | Best Match | % ID | % Sim | Length (bp) |
|---|---|---|---|---|---|
| Sensors: | | | | | |
| HI0221 | 239,378 | arcB (*E. coli*) | 39.5 | 63.9 | 200 |
| HI0269 | 299,541 | narQ (*E. coli*) | 38.1 | 68.0 | 562 |
| HI1713 | 1,781,143 | basS (*E. coli*) | 27.7 | 51.5 | 250 |
| HI1381 | 1,475,017 | phoR (*E. coli*) | 38.1 | 61.6 | 280 |
| Regulators: | | | | | |
| HI0728 | 777,934 | narP (*E. coli*) | 59.3 | 77.0 | 209 |
| HI0839 | 887,011 | cpxR (*E. coli*) | 51.9 | 73.0 | 229 |
| HI0886 | 936,624 | arcA (*E. coli*) | 77.2 | 87.8 | 236 |
| HI1382 | 1,475,502 | phoB (*E. coli*) | 52.9 | 71.4 | 228 |
| HI1714 | 1,781,799 | basR (*E. coli*) | 43.5 | 59.3 | 219 |

SEQUENCE LISTING (1 sequence)

SEQ ID NO: 1 - DNA, 1830121 bp; double-stranded, linear
ggccgcggtgcatcacaaaacatcattccatcttcaacaggtgcagcgaaagcagtaggtaaagtattacctgcattaaacggtaaattaactggtatggctttccgtgttccaacgccaaacgtatctgttgttgatttaacagttaatcttgaaaaaccagcttcttatgatgcaatcaaacaagcaatcaaagatgcagcggaaggtaaaacgttcaatggcgaattaaaaggcgtattaggttacactgaagatgctgttgtttctactgacttcaacggttgtgctttaacttctgtatttgatgcagacgctggtatcgcattaactgattctttcgttaaattggtatcttggtacgataacgaaacgggttactcaaacaaagtattagacttagtagctcatatctacaactacaaaggctaattaaaactttgaaaaaattaaccgctcttcggagcgttttttattatctagaatttaatttacgctctaaaaatgaacaagggatcactaaaaataatttaaaacaatcaatattcttctagcttttattcctatttaagattatattagcgcacaactgttcgctcaatgaaaatcaaaaatagggttaatatgaatctcgatctccattttgttcatcgtattcaacaacaagccaaaactcgtacaaatatgaccgcacttcgctataaagaacacggcttgtggcgagatatctcttggaaaaactttcaagagcaactcaatcaactttctcgagcattgcttgctcacaatattgacgtacaagataaaatcgccatttttgcccataatatggaacgttggacaatcgttgacattgcgaccttacaaattcgagcaatcacagtgcctatttacgcaaccaatacagcccagcaagcagaatttatcctaaatcacgccgatgtaaaaattctcttcgtcggcgatcaagagcaatacgatcaaacattggaaattgctcatcattgtccaaaattacaaaaaattgtagcaatgaaatccaccattcaattacaacaagatcctctttcttgcacttgggaaagttttattaaaacaggttcaaacgcccaacaagatgaactaacccaacgcttaaaccaaaaacaattatcggatttatttacgattatttatacctcaggcacaacgggagagcctaaaggtgtcatgttagattacgctaatctcgctcaccaattagaaacacatgatctttcacttaatgtgacagatcaggatatttcactttcttttttaccattctctcatatttttgaacgggcatgggcggcttatattcttcatagaggcgcaatactttgctatttagaagacactaatcaagtgcggtcagctttaacggaaattcgcccaactttaatgtgcgccgtaccacgtttttacgaaaaaatttatgctgccgtattggataaagttcaaaaagccccaaaacttcgccaaattatgtttcattgggcaatttccgtgggacaaaaatattttgatctacgtgcgaataacaaagctattccgttcttattgaagaaacaatttgctttagcagataaattagtgctctcaaaacttcgtcaattattggggggacgaataaaaatgatgccttgcggaggagcaaaattagaaccggctattgggctatttttccatgctattggtatcaacatcaaattaggctatggtatgacagaaacaactgcaaccgtttcttgctggcatgatttccaatttaacccaaattcaatcggcacactgatgccaaaagcggaagtgaaaattggggaaaataatgaaatccttgtgcgtggcggaatggtgatgaaaggctattacaagaagccagaagaaacggctcaagccttcaccgaagatggtttcttaaaaactggcgatgcaggagaatttgacgaacaaggcaatttatttattaccgatcgtatcaaagaattaatgaaaacctcaaacggcaaatatatcgcaccacaatatatcgaaagcaaaatcggtaaagataaatttatcgaacaaattgcgatcatcgctgatgcgraaaaatatgtatccgcgcttattgtgccttgctttgatagtttggaagaatacgctaaacagctcaatattaaatatcatgaccgtttagaactactaaaaaattctgacattctgaaaatgtttgagcatcgtattaatgcggtgcaaaaagaattggctcatttcgagcaagtaaaaaaattcacgttactttctcaagcattcagcattaaattaggcgaaattacaccaacattaaaattacgtagaaaagtgattttagaacgttatcgcaagcaaattgaagcaatgtatcattcacaagaagcatagctaaaaggctctcaattgagagcctttcttttctaattattcaggaaatttttcttctaaaatcaatgcaagtccatcttcattattggttgccgtaaccacatttgcagcttgtttaatttcatttggcgcatttcccattgcaacaccaagccccacatgttctagcatatccagatcattaaaattatcgccaaatgcaatcacttcattagtttgtacgccaaaataatcttccaaaaaacgcaccgcacttcctttggttgcactcttgtgcattacctctaaaaaattagcgtgggaacgacaaatacttaaatgtggaaatttttcctttaaaagaacttcaatctcaatgatttcttctgcttccccaataatttgaattttatgtggcgaacgtgtcgctacttcatcaaaaggatgaatctcaattttggtcacgctgcgttcataaatcacccatttattttctacatcgcgcgcatggcaatcattatttgtataataattcacgccaagcaaaggatgttccgccaaaacagtattaatctctaaaatatcttttggctcaatttgtacgctataaattggttcgagattttggttcaaaataagcgcaccactaaatgcaacaagtacattattcgtttcaagctgtttccaataaggcaaaatacctaaaggagaacgcgccgaaattggcacaaaaggaatgccattcgccgttaaacgcttaattaccacaacagttcgaggggaaattgtatgttgagaggttaataaggtgccattaaaatcactaaatactgctttatacatcattactccgaataaagattatttctctgctagataaggatcatcaaagcctaatccttgcataatttgggtttctaaactttccatttcttccgcttcatcgtcttcaatatgatcataaccgagtaaatgtaagctaccatgcacgaccatatgcgcccaatgtgccattaatggtttctcttgttctgaggcttctcgctccacgacttgacgacaaataacgagatcccctaacaatggcaactccacctcatcggggcattcaaatggaaatgaaagcacgttagtcgggcgatcttttccacgataagttaaatttaattcatggctttcggcttcatccacaatacgcaccgtcatttcgacttcattgccctcaggctgaacagcacctgttgcccactgcacaatctgctcttctgttggcaaaccctctatattttctgtggcaatttgcaaatcaaccaatacacttcccattctattctcctaaattcttttcaatttctaaccgcacttttgcacttattgaatacatataacaaacggtgggcttatgaccacttttgtatgtgtaaaaatgaggggaattatacaataataaacctaccaatcccctaaatttagattacataatttatgtttaccgctaatttactctatttttaacgtacaaagagacaaatcacgctatttccttaatcaacacaaaacctcaaatctctcgctcttggttgaggttaattgtgaagtcgtagatgtccgctataaatatttccttttccttccctagcaaaaccaattaaagtcaaattatgtttttctgccattgttactgctaaatccgttgcggcagaaatcgtgactaacatttccaccccgcaagccactgttttttgcaccatttcataactcgctcgactggaggctaaaataaaacctctaggtttacccgattttgcgtgccaaccaagcaatttatctaatgcaacgtggcgacccacatcttcgtaaatagctaacatacttccatataaatcgaaaaatgcacaagcatgggtagcaccagttttacatccaagcaattgatttttttgaagatcaataagacaactatctagcaaatttaaatcaaattgaaaagtacagtctaatttcggaaaagttttatatacttgattcaattgttctgtaccacaaataccacaaccagtacgccccgtaagattacgacgatgctcttttaatgccataaatttacggctggaaagttcaatttgcacttcaataccattgcaaacttctacaacatcaataccataaatatcttctggtttattgataattccctctgttagagaaaagcctaaagsaaaatcctctaaattgtttggggaacacatcataactgcgtgagaaatgccgttatataccaaagaaactggtatctcaacagccagtatgtcctctttttgttgcaaaagtgcggtcaattttnctgtattttttgtctttctaaaaaagttgatagtttgtcgaatccagcactgcatttattaccagtccattagttaaatgtaaaaagtctgttaaattatttttatatttatgatctagatcacaatatttgttgaagctaatgtcatttgattatggatttatcgttaaaaaatcgttactctagccatccaataaatcaacgtttttacgatgatttatatactagagagtattattttaacgaaatcaacataatctagctactaaacgaattttattactatctataatatctcaacaacttgttgttgaaaggagtgattatgcaggtctcaagaagaaaattcttcaagatctgtgcaggaggtatggcgggaacgtcagctgcaatgttgggctttgctccagcaaacgtattagctgcgccacgcgaatataaattattacgcgcgtttgaatcccgtaacacctgtacatattgcgctgtaagttgcggtatgttgttatatagcacaggcaaaccttacaattcattaagcagccatactggcacaaatactcgttcaaaactctttcatattgagggtgatccagatcatccagtcagtcgtggtgcgctttgcccgaaaggtgctggctcactcgattatgtcaatagtgaaagccgttctttatatcctcaatatcgtgcgccaggttctgataaatgggaacgaatttcttggaaagatgccattaaacgtattgctcgtttaatgaaagatgaccgagatgccaactttgttgaaaaagattcaaatggaaaaacggttaatcgttgggcaacgacaggaattatgactgcatcagcaatgagcaatgaagctgcgttattaacacaaaagtggattagaatgctcggtatggtgccagtatgtaaccaagcgaatacttgacacggaccaacggtagcaagtcttgctccatcatttggtcgcggtgccatgacaaataactgggttgatattaaaaatgccaacttaatcatcgttcaaggcggtaaccctgcagaagcccatcctgttggcttccgttgggcaattgaagcgaagaaaaacggtgcgaaaatcatcgttattgatccgcgttttaaccgtacagcatccgttgctgatcttcatgcgccaattcgttctggttctgatattacgttcttaatgggcgtgatccgttacctattggaaacaaaccaaattcaacacgaatatgttaaacactataccaacgcatcattcttaattgatgaaggtttcaaatttgaagatggtttatttgtagggtataacgaagaaaaacgtaactacgataaatctaaatggaactaccaatttgatgaaaatggtcacgctaaacgtgatatgacattacaacatcctcgttgtgtcattaacatcttaaaagagcacgtttctcgttataccccagaaatggttgaacgtattacaggcgtaaaacaaaaactcttcttacaaatctgtgaagaaattggtaaaacctctgtgccaaataaaacgatgacgcatctatatgcattaggttttacagagcattcaatcggtacacaaaatattcgctcaatggcgataatccagttacttttaggtaatatggggatgccaggtggcggtattaacgcattacgtggacactccaatgtgcaaggtacgacagatatgggcttattgccaatgtctttaccaggttatatgcgtttgccaaacgataaagatacctcttacgatcaatacattaacgcaattacaccaaaagatatcgttccaaaccaagtgaactattatcgtcatacttcaaaattctttgttagcatgatgaaaactttctacggagataatgccactaaggaaaatggctggggattcgatttcttaccaaaagcagatcgcctatatgawccaattactcacgttaaattgatgaatgaaggcaaattacacggttggattttacaaggttttaacgtattaaattcactaccaaataaaaataaaacgttatctggtatgagtaaactgaaatacttagtcgttatggatccattacaaactgaatcatcagagttttggagaaattttggtgagtcaaataatgtaaatcctgcagaaattcaaacagaagttttccgtttaccaactacttgtttcgcagaagaagaaggatcaatcgttaattctggtcgctggactcaatggcactggaaaggttgcgatcaaccgggagaagccttacctgatgttgatattctttctatgctacgcgaagaaatgcacgaactttataaaaaagagggtggacaaggaattgaatcttttgaagcgatgacttggaattatgctcaaccacactcaccaagtgcggttgaattagccaaagaattaaatggttatgcgcttgaagatctttatgatccaaacggtaacttgatgtacaagaaaggtcaattactcaatggatttgcacatttacgtgatgatggtacaacaacatcaggtaactggttatatgttggtcaatggactgaaaaaggcaaccaaactgctaatcgcgataattcagatccatcgggtttaggttgtactattggctggggctttgcatggcctgcaaaccgccgcgtactttatagccgtgcatcattagatatcaatggtaatccttgggataaaaaccgccaattaatcaaatggaacggtaaaaactggaactggtttgatattgctgactacggtacgcaaccaccaggttctgatactgggccgttcattatgtccgcagaaggcgtaggacgtttatttgccgttgataaaattgcaaatggcccaatgccagaacactatgaaccagttgaaagcccaattgatacaaacccatttcatccaaatgtagtaaccgatccaactttacgtatctataaagaagatcgtgaatttattggttcaaataaagagtatccatttgtagcaacaacttatcgtttaaccgagcatttccacagctggactgcacaatctgcattaaatatcatcgcacaaccacaacaatttgtggaaattggcgaaaaattagcggcagaaaaaggcatccaaaaaggcgatatggtaaaaattacttctcgtcgtggctatattaaagcggtcgccgtggttacaaaacgtcttaaagatctcgaaattgatgggcgtgtcgtacaccatataggtcttccaattcactggaatatgaaggcattaaatggcaaaggtaaccgtggattctctacgaataccttaacaccatcttggggtgaggcaatcacgcaaacaccagaatacaaaacattcttggtaaatattgaaaaagttggggaggcataatatggctggaactgctcaaggcgttcaaacgcaagacgttattaaaatctccgcaacatctggtttaacaccagcaccacaagcgagagatcataaagttgaaatcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacagtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtagatcgtgtttctgtgggacaagagcccgcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtkttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatctaagggggaaaataatgagtaaaattgaaattagcaacgatactcgcattatccgccatagaaccccagcacgtatcagtcactggatgttggttatttgcttttttatgacgatgttcactggtgttgcatttttcttccctgactttgcttggctcacagaaattttgggtacaccacaaattgcgcgcgccattcatccattcacagggattttaatgttcttcgctttcatctacttagcgttattgtactgggatcacaatattccagaaaaaaacgatattcgctgggcgaaaggtgttattgaagttcttaaagggaatgaacacgcggttgctgataatggcaaatataaccttggtcaaaaaatgctcttttggacattaaacttggcaatggtaacgttattagtcactggcatcattatgtggcgtcaatatttttcacattacttctcaatcccagtattgcgaattgctattttactccactctgcaagtgcttttatgttattcactggtatcttagtgcatatatatatggcattttgggttaaaggatcaattcgcggtattgttgaaggttgggtaaccgttcgttgggcgaaaaaacaccacccaagatggtatcgtgaagaagttttatcaaaacttgaggaagatttactcaacgagcaatctggcaaagtaggtaaaaccaaagtcttatttaaaggatttggcaaataagctgaaatcctgaaaaagaaaaagtgcggttaaaattgaccgcactttttattataaaagtgagagaatatgagtatcaaaatcttatctgaatcagaaattaaacaagtagnaaattcatatcaagccccagcggttttatttgccaatcctaaaaatctttaccaacgcagagcgaaacgtttaagagacttagcacaaaatcatcctctatctgattatttattatttgctgcagacatagttgaaagccaactttccacgttagaaaaaaatcctttaccgccacaacagcttgaacagttaaatactatcgagccactaaatgccaaaacctttaanagaaacagtatctggcgtgaatacttaacagaaattcttgatgaaataaagcccaaagctaacgagcaaattgctgcaacaattgaatttcttgaaaaagcctcttccgctgaattagaagaaatggcaaataarckcttagcacaagaatttaacttagtcagcagtgataaagccgtctttatttgggctgcactttccctttattggttacaagcagctcaacaaattcctcataatagccaagttgaaaacgctgaaaatttacatcactgccctgtttgtggttctttacctgtggcaagtatggtacaaattggtacatcacaaggtttacgctacttacattgtaatttatgtgaaagtgaatggaatttggtacgcgcacaatgcaccaattgtaatagtcatgacaaactcgaaatgtggtcactaaatgaagaacttgcgcttgttcgtgccgaaacctgtggtagttgtgaaagttacttgaaaatgatgttccaagaaaaagatccttacgtagaacctgtagccgatgatttggcttctattttcttagatattgaaatggaagaaaaaggtttcgcccgaagtggattaaatccatttatttttcctgcagaagaagcataaaaatatagcctagaaatatctaggctaattatttaaatctatagataacacgccattaccactgcattttctcgtccaccactgggtttcggataataatttttccgaatatccacttcattaaaaccaattttttcatacaagaaacgagcagagttagactctctgacttctagccataaggtttggacacctttttcctttaattgaaagattaattttcctaacaataatttgccaaatccacaaccttgataagtaggcaaaatcgcaatattaaacaaagtcgcttcatccaatactgtttggcaaatagcaaaaccgataatctgattattctctattaattttaaattgagataacgctccccttgattattttttaacgtaccaaatgaccaaggcaccagatgggcttgctgttcgatttcatacaatcgctcgaaatcacaggcttcaatttgagaaataatagacataattaaggctgctgaatttgttgccacaacgctcgtttggcttgatgattagattgaaattgctgccaacttggcgagcgataaacctgctcagcctgcttgcaaaatggcaaagtgcggtcaatttggtcgctattttctgatagtaaccaataacgaataggctgtttacattccatatgctggatttgatcgtaattcaaacataaacaattttcttttttaagattaaggcttaacagcacatcagccaacaaaggcgagctactgatattttcatcggaaacagtgataaggcgaatattctctgccacactaattcctactgaaccttgcagtacctcggggcgatataattcccactgggaaatgcccatttcttgtaaaagaagatcgcgtctgttcataagtgaatttttaaaaacgttgcttgaaaaatagtgttaatttcttttattaatctttgctaaaatggtgcgtaattttaaccaataacccacaggattcaaagcgtgatttctctagaaagccaagttttagaacgccatatttcattttttgatggtaaatcggtattatttgctggcggtatttctgatagttttcctcaaacattagcctcaaaatgctcatcaatccaaatttggagttgctattttgactatgcaagaacacaaagtgcggtcaatttttccgttgaatttcaaggtcaagcggatttaatcgtttattattggactaaaaacaaacaagaagtcaatttccaactgattcaactattagctcaagcatctattggtcaagaaatattaattattggtgaaaaccgttgtggcgtgcgttcagtagaaaaaacattatcaccctatggagaaatagcaaaaattgactctgctcgtcgttgcggtttatatcatttttcactccaaaataaaccgcactttgaacttaaaaatttctggagaacctaccaacattcaacacttgaaaacttaactatatatagtttacctggggtatttagtgcggcggaattagacacaggcacagaactgttactttcaactattgataataaaataaaaggaaaagtgcttgatcttggctgtggggcgggggtaattggctctatgataaaaaaacgcacgcctaacgcacaaattacaatgacagatattcacgcaatggcattagaatcagcgcgtaaaacactttctgaaaatcaattacaaggcgaggtttacgccagtgatgtcttttctgatatagaaggaaaatttgatttgwtcatttctaatcctccattccacgatggcattgataccgcctatcgagcagtgacagaactcatcactcaagcgaaatggcatctcaatcaaggtggagaattacgcattgtcgccaattcatttctgccttatcccgaattacttagacaacatttcaatgattatcaagttcttgctcaaacaggaaaatttaaagtgtattcagtgaaaaattagaaacaaaaaaatccccatcacaataatggggatttttattatgcgtataaattttaccgcattttattcatccatatatcctaaactacgcagcgcacgttcatcatcagcccaaccagatttcacttttacccaaagttcaagatggactttgttatcaaataaacgttccatatcggctctagcttccataccaatagttttaattttttgaccgcccgcaccaatgaccatttttttctgaccttcacgttcaacgagaattaagccatttatttcataagtgccacgttcatttactttgaattgttcgatttcaacagtaacagaataaggcaattcttcaccggtaaaacgcattaatttttcacggattatttccgaggccataaaacgttgcgaacgatctgtgacataatcttctggaaaatgatgcacaccttcacgtaaagattggcgtacaattttctctaattcatgaacattattaccacgctgtgcagaaattggcacaatgtgagcaaagttaaatttactgctaagatctgtaataaacggcaacaaatcatctttattcttgatgttatctactttgttgatagcaagcacaacgggtgcttttgcattacgtagtttgtttagcaccatctcatcatctgcattccagtgtgtaccatctacgacaaaaataattaaatcaacatcgccgatagcactacttgcggcgcggttcattaagcggttaatcgcccgtttttcttcaatatgaagccccggtgtatccacgtagatttcttgatacgcaccttcagttttaatcccaacaatgcggtgacgggtagtttgtgctttacgcgatgtaattgaaattttttgtcctaaaattttatttaagagcgttgatttacccacatttgggcgacctacgatagcaataaagccgcaataggttttgtcgaattgttcggtcatttgatgtccagttcttttaaaatttgttctgctgccgcttgttcagctttacgacggctagatccttttgccacaaaagtgcggtcaattttctccgcacttttcactttgcatttaacagtgaaaatttggcaatgggcttccccttgaatattgaccacttcataagttggcaatggcaaatgtttgccttgtaaatattcttgtaaacgcgttttcgcatctttttgattatcgcctggtttaatttctgccaataactgttgataccaatttcgtatcacttgggtcgtcacagccaatccttgatccaaagacattgcacctatgatcgcttctacacaatcggcaagaatagattcacggcgaaaaccaccgttctttagctcgccagaaccaagcgacatataatcgcctaattcaaattggcgcgctaaaatcgctaaagtgggttcgcgtaccaaagtagcacgcatacggctcagttctccttcattacaacgtggaaactgatgataaagtgcttcagcgatagtgaaattaagaatggaatcgcctaggaattctaggcgttcattatgttgagttgccgcacttcgatgcgtaagtgcctgctttaagagcgctatatcattaaaacgatagccgattttacgctcaagtcgatctaaatgattcatcttattttattgctgtaaagaaacgctcaaaacggaaacctgttggccattcattcgcttctttttctaagctcatccaaatataagtggctttacccacaatatttttttcaggtacaaagccccagaaacgactgtcatcgctgtgatcgcgatgatcccccatcacaaaatactgcccctctggcacaagccattctgcagtttgcattccctcttgtgggaaaaattcaaggtctgaataacgacgatactcactaattaacacgttatgtgttacatcgcctttttcagtcaattctaattcatttggaaaagcaggatttgttggattttgtgtatattcaaacgccttagtttcgcaatcaatttcacagggtttcccctctttaccatataccacttttagcgttttttgttccacatcaaaaatgacgcgatctccgccctttccaacaatacgcttaatataatccacaccagacatattatcttttgaacttaacgctaaattttctgcaaaagccgctcgtgttgccccaagaccagtacgaattaacgcttgttgtggtgctttaaacacaatcacatcgccacgttgtggtttttcgcctgcaataatggtgttttggaaaatcggatctttcacaccataagcatatttattcacaactaaaaaatcgccaacgcgtaaagtggactccattgagccagagggaatttgaaacggttcaaacaaaaaagaacgaaccaaaaataccactgcaagcacaggaaaaagtgaagacaaaaattctgaagcctcagaaatcggttcaattttggctttttcttcctcacttaaggttttaccagaacgttgttctgcacgtgccacttgacgatgacgttttggcagcaccacaaaacgatgataacaccataatacgccagaaagtgcggtcaaaattagtaacaaaatactaaaagtatttggtaactgaaaataatctaaaactttccacacaccaaagccgacagccaataaaatcacaaaaaataaatttgacataattttccttatttatcttttcctacgtgtaaaattgctaaaaacgcctcttgcggcacttctacgttacctaaagacttcatacgttttttcccttctttctgcttctgtaagagttttttcttacggctcacgtcaccaccataacattttgctaatacgtttttacgtaattgtttcaccgtagaacgagcaataatatggtttccaatcgctgcttgaatagcgatatcaaattgctgacgaggaattaactcacgcattttttcaaccaattcacgaccacgatattgtgaattatctttatgaacgattaaagccaacgcatctactcgttcgctgttaatcataatatccacgcgaaccatatctgccgcttggaaacgtttaaaaccgtaatctaacgaagcataaccacgcgatgttgattttaaacgatcaaagaaatctaaaaccacttcgcccattggaatttcataagtcagcgcaatctgattaccgtgatataccatattggtttgcacgccacgtttttcaacgcaaagggtaataacgttacctaaatattcttgcggcaccagcatattacattctgcgattggctcgcgaatttcagcaatattattaagtggaggcaattttgcaggactatccacataaaccacttcaccattggtcatttcaacttcataaattacagttggtgctgtggtaatcaaatcaagatcgtattcacgctctagacgctcttgaatgatttccatatgcagaagtccaaggaaaccacaacggaaaccaaaaccaagcgcggtcgaagtttctggttcatagaaaagtgacgcatcgtttaaacttaatttaccaagtgcatcgcgaaacgcttcataatcatcagaacttacagggaaaagcccagcataaacctgtggttttacttttttaaagcctggtaaaacctcagttgcagaattatgttgatgggttaaggtatcgcccactggcgcacctaaaatatctttaatcgcacaaacaacccaacccacttcgccgcattctaaaacggtagtatcttcttgttttggcgtgaaaatccctaaacgatctacgttataagtttgccctgtggacatcactttaattttatcgcctttacgtaataccccgtttttaatacgcactaaagataccacgcccaaataattatcgaaccaagaatcaataatcaatgcttgtaatggcgcattaggatcaccttctggtgcaggaatttttgccacgatttcttctaatacatcttcgatacctacacccgttttagctgagcatcgaaccgcttccatcgcatcaattccaacaatatcttcaatttcttcagcgacgcgttcaggatcagcagctggtaagtcgattttatttaaaatcggtactacttctaaatccatttcgattgcagtataacagtttgctagagtttgggcttctaccccttgaccagcatcaactaccaacaatgccccttcacaagcagcaagagagcgagacacttcataggaaaagtccacgtgtcctggtgtatcgataaagtttaattgataagtttcgccatctttggctttataatttaaagtaacactttgtgctttgatggtaattccacgctcacgctcaagatccattgaatctagcacttgcgcttccatttcacgatccgaaaggccaccacaagtttgaatcaaacggtcagaaagtgtcgatttaccgtggtcaatatgggcaataatagaaaagttgcgaatattcttcataaaagattgtttttctcaaaaatcattaaatttaactggcggattgtacctgaaaagcgcggaaatcgctagggatgaaagggaaaagtgcggtcaaattttcaaactttttagataaaacaaaaccccgaataacttcggggtttcttttttcattcaaactgaaattataggctttcagtgaaagtacgagtgatcacgtcgcgttgttgttctggcgttaaagagttgaaacgtactgcgtaaccagaaacacggatagttaattgtggatatttatctggattgtttaccgcatcttctaacgtttcacgacgtaatacgtttacgtttaagtgttggccaccttcaactttaacagttggtgctacgtttactggtaattcacggtattcgatttgacctaattcgctaactgcaacaacttggtcttcagcgaattcgccttttgcacataagcaacgtgcttcatttttttcgctgtctaataaccagaatgaattaagcaaattgtcatttgctgcttgagtaatttgaatacctttaatcataatagcctcctaattggcacgaaaataataataaaactgtacaaattttatcaaatcattttaatatttcaaattattttatatttatttgataaagagcaggttatttttttaattaatttttataaatttgatctaaattaaaattcattaatttttaaataaaatttatatcaataatttaacattaatttaactttttattgaatgaatgtttttgtttataatgaataaaaacttattaataggataaaataatgaaaaactggacagacgttatcggaacagraaaagcgcaaccttactttcaacacacactacaacaggttcatcttgcaagagcaagcgggaaaacgatttatcccccacaagaagatgtatttaacgcattcaaatatactgcttttgaggatgtaaaagtggtaattttaggtcaggatccttatcatggaccaaaccaagcgcacggcttggctttttcagtaaaacctgaagtagccattcccccttccctattaaatatatataaagaactcacacaagatatttcgggatttcaaatgccatcaaatggttatttagtcaaatgggcagaacaaggggtattgctacttaacactgtgcttaccgtggaacgaggtatggcacattcacacgccaatttaggttgggaaaggtttacagataaagttattgcagtactcaatgaacatcgtgaaaaactggtgtttttactttggggcagtcacgcacaaaaaaaagggcaaatgattgaccgcactcgtcaccttgttttaacggctccgcatccttccccgttgtcagcacatcgaggtttctttggttgtcgtcatttttccaaaacaaattcatatttggaaagccacggaataaaaccgatagattggcaaatctaaaccatatatctctaaaaaataaccgcactttaatctctcaaagtgcggttaaatatttcagtattttaattagccgtgataacgccctacgcctaattcatcttctttacgtgtgcgattcatcacttcttgtggagattgcgcaatacgtaatcccatttcatcttcagtacgcaccacttcgccacgtaacgaattagtataaacatcagtgattttcacatccacaaacttaccgatcatttctggagaaccttggaaattaacaatacgattcgtttcagtacgtcccgtcaattccataatatctttcttcgatgggccttcaactaacacgcgctgctctgtgccaagcatacgacggctaaattgtgccgcttgttgattaatacgctcttgtagcacataaagacgctgtttcttttcatcttccgtgacatcatctggcatatctgctgctggcgtacctggtcgggctgagtacacaaaactgaagctcatatcaaagtttacttgtgcaatcaaattcatagtttgctcaaaatcttccgccgtttcaccagggaaaccaacaataaagtcagagctgatttgaatatctgggcgcacagcacgaagtttacgaataatggatttatattctaatgcggtatgagcacgtttcatcattgttaatacacggtcagaacctgcttgcactggaagatgtaagaaactcactaattcaggcgtatcacgatacacatcaataatatcatcggtaaattctattggatgactggttgtgaacgtaaacggtcaataccatcaattgatgcgacaagacgaagcaactcagcaaagctgcaaatttgaccatcatgcgttggcccacgataagcatttacattttgaccaagtagattgacctcacgcacaccttgttccgcaagttgcgcaatttcaaatagcacatcatctacaggacggctaacttcttctccacgagtataaggcacaacacaaaaagtacagtatttattacagccttccataatggaaacaaatgccgttgggccttctgcgcgaggttctggtaagcggtcaaatttctcaatttcagggaaacttacgtctacgacggaactttttccaccacgaatttgattaatcatttcaggcaagcgatgcaaagtttgcgggccaaaaataatatccacataaggcgcacgatggcgaatatgttccccttcttgagaggctacacagccgcccacaccaatcactaaatttggattatttttctttaattctttccaacgcccaagttggtggaacactttttcttgtgctttttcacgaatagaacaggtatttaataataatacgtctgcttcttcaggtgcttccgtgagttctaatccgtgggtgcttaataaaagatcagccattttagatgaatcatattcattcatctggcagccccaagttttaatatgtaatttttgagtcattttctacaatatcgttaggtgttataaataattagttaaataaagcaatgggctattctacagcttgcgctaattctggctagtgaatattcggtgaaagacactaaacagaatattttgataagctagaaaggcttgtaaatcattaaaaaaataagatattcataaatatactcaagatataatgcagtatgaggtaaatattagttcataaaattaaaggaaatactagcttatcgcgattacaacgatgtgtatattcaaggtaaaccaaaaggattaagccctgtagattacaggacttaatccttaaattaaatagagctcactttttagtgaaagcgcaagcatatatttataatcaactactttgtctactacaccgtcaaaatagcagttaaatttaaaaaagattagcttataaccagcctaaactcattaataatttccaccatgccataccgatagttagatggataattaaactaccaaaagcaatgatcgcgccagtaatccaccaagattttatatcattataacctgcaccgaatgcaattggacctggtccgcctccgtagtgagttactgaaccaccataagaattagcaaagactaagcctagagcaagcaattcagtaggagcgcctgttacatgtccgactgttgcaaatacgggtaccattgcagctacatatgcaccgcctgatgcgaataaataacgtacagagacacttaaggtaagaatcactattaacgccatcataccatgtccctcaaactgaagtatggtacttaaggtgtttgctaaccatttgaaaaagccagatttttcaagcaagccagacataccgatgataccaccataccatactagggtattccatgcgcctttgctttttaggatatcgtcccaggtgacgatacttaatacaatacaaagcaccattacaatgattgcaacaatggtagcattgatatgaagtgaattagagaaaatccagccgaataatgcaattacgaataacacgctgagtgctttttcacgaaaagacattggacctaattcttctaagccttttttcgcaatggctttattatccacttttttcaattctggtggagatacccaataacaaattaacggaattaagaataagcagagtaagccgggtacggatgcagctaagaaccatttgatccaagtggtttcaaaaccaagaattggtgccattaatgaaagagctaaggcattaggagccattgcggttaagaaaatataagaggtagttttaaccaccatatatacgttcatcatcaaataacgccctgcttttttcgggcttttttctggatctgaaccaagagcaaccactacgctattaatgattggaaagataatcccacctgaacgcgcggtgttagagggcgttgctggcgagagtaaaagatctaagaacatggtaacatagcctaagcgtagggttgtgctacccattgcgccgatcatatgataggcgatacgtttacctagacctgtgattacaaatgctgaactcaaagtgaatgcggtaaaaataagccatgttgtgccagatttataaccatccaacatattgccgactttaaccaattctttcgccccttcagtattaccgatgataacgccagaaaccgcaattgcagccaataagataacgggctcgccataaggtttaagcacaagcccaacgatagtggcgatataaacaccaagtaatcgccaagcaatcaaagaaagcccatcaggagcaggtagtaagaaagtgatcaatgggatagccattaaaatcaccagttttgtatttttggataatgccatattaattacctctaaatgataaaaagaaaattgttagtgctaataaatcagcactaccgcccgaacttaaattacgttcaatgcaggcggtatcaaatttcattaatgcttgtgtcagtgctgttttatctgtcacaaggtgttgatctgtaagcagatcctgtgctgtttgctgtatgaaatacaatcccgctaaaccacctcgatgaaccacgttagtgtcggagttaattgccattaaattcaacaacaaaatcagtaaacgatgttcccattctaactgatggtactcatcaaattgtggcaacaacgtttgaatgagattaaaaccattttctgcttcgccacggacacctgttaagccatatttttggaataaacgcactccagccgtactaggcaagtgttcaggataatttttcagttcatccgttaaaccttgagtaaattgtgcaacaagtgagcagattaatttaacatcaaaatctaccgcactttgaaccaaacttttttgtgccaataatcgtccaattgccgtacacactaaaccaaaagaaaaaatagctcctttgtgggtgtttacgccatcagtaactttaaacattgctttttctgctaataaacctaaaggacgaatttcagagagaatttgattttcagacaaatgcgcggtcatcatgcctttgagaacaaactgcgtaaaaaaaggttttaaactaatcgcactttgctcaaaagtatgtaggttcatatctttgtgcgaaccgttattgatggcatccactaaaccaggttttggcgataagcgagcctcttgtattaatgccagataaacttgttcaccaatatgttctgcgaaatcatgattctgtgcgagagattgaattttatctacaatctcatcaatctcgtgcttgtgggttctcgcacagatttttgcattttctccgcacactaaacaagttcttggagaaagatcaaaatctgtacgactcagtagattgcctttagcattaaacacatctaaatcccacaaacgagcaagaggaatactttcttccaattcaatcatcagaacttttagcgtacgagcatctatcggtaatacaaaataggcttcatgccccgtttctagcggacggattatttcttttactgctgtgatgtttaactgagtaaaaagtgcggtcagattttctagagcttttgtaaaaacataatccaacaaagcatttttttttactccacccacagcagttaaagtgatgcaaagtaaggtttgtccatattgtgttataagctgttgttgtaaaattgcacgttcctctcgagcattaagcaatgcttcaagtgaaatttttgaaccctctgtagagaatgtcgtaaaaaaatgctgcaaaatttgaccgctcttttgtataaaaataaattttcttaactctttccatttatatggtgctggcgaaagctgaaagagctaattgagtccctttcaactctttgggctcctttcctgataatcatgggaagacaagagttaattttggctattgaaagtagatcgcttgtaatgctgattctagtctttaacttgatacaccgtatcaatcaccgaaccatcacgataacgaacaacagccacaggtttattagtaaactcaatttcttttggtttaccagtaatgctgtaagcacgttcacaaagttgttcaatagtaaacaatggaatgtctgttttgcttaaagcttcaatcaaatctggacgtttaggatttactgctacaccatgatcggtaacgagaatatcgacgttttcaccaggtgttacacaggtaatcacgttttccaccacggttggaatacgaccacgaactaatggtgccacaatgattgctacttgtgcagaagctgcggtatcacaatgaccaccagatgcaccgcgaatcacaccgtcagagccagtcaatacattcacgttaaatttagtgtcgatttctaaagcagaaagaatcaccatatctaaacgttcaacagatgcgcctttggaactgtaattcgcatattggttagcggagacttcaatatgatttgggttacgggcaagtgattcagctgcaacagaatcaaagctttgtacatctaataattttttaataagaccagcctcatgtaatgccaccatacttgcagtaattccgccaagtgcgaaatctgcagtgatattttcacgacgcattttttcttctagaaagcgtgtaacagctaatgctgcccccccagaaccagtttgtaatgagaagccatctttaaaataaccactggcaaaaattacttctgcacatttacgcgcaatgagtaattcgcgtggattggtagtcattcgggttgcaccaccaccaatttttttcgggtcaccgactgcttcaacttgcacgattaaatctacttgatcttgagctatgctgattgggtggtgcgggtattcaacaaattcctctgtgagcaacacaactttgtcagcatattcagcatcgacacgcgcatagcctagagagccgcatttactttttccagtaaatccattggcattaccgaatgtgtcacagcaaggcacgcctaaaaaagcaacgtcaatttttaattcgccagattttactaagtgaacacgtccaccatgagaatgaatatttacaggttcattcaataaaccgcgagagatttgctctgcaagttcaccgcgtaaaccagaagaatagattttggtgaccacgccatttttgatatgttcgacaatcgggaagtggctatcaattaaagatgaagatgcaagggtcagatttttgaaacccatttcggcaattttattcatcaccatattcaccacaaaatctccgccccgaaaagcatgatgaaatgaaacagtcataccatcttttaagccagagcgtttaatcgcttcttctagagaggtacaaagtttgcgatctttcgctgtacgagaaagggattcagatttaggcaccgcttgatagactgagcgatcagcgtgatatttttcaatacgttgttctcttgttgtcatctttttatctccctttactcttcacgaatacctgatttcgcacgttctaatacaagttttgcgcgatcaataatcggtgcgtcaatcattttaccgtttaacgaaacaacaccagccccttgtcgttcagcttctactgccgcttcaataatgcgttttgcctgctccacgtctttttgtgtcggtgcaaataagttgtgtaacaattcaatttggcgtgggttgattaaggatttaccgtcaaaaccaagctgtttaattaacgcagcctcttttaagaagccttcttcattgttcgcgttagaatatacggtatcaaaagcctgaatgcagccgcacgtgccgcttgtaaaatagaacaacgagcaaaaagcagttcaatcccctctggtgaacgctcggtttttaagttacgtacgtaatcctctgcacccaatgcgataccaattaaacgtttagaagcgaaagcgatttggttggcttgagtgatacctaatggcgattcgattgcggctagcattttagtcgaacctgcttctcgaccgcaagctttctcaatctcagtaatggcgtgatccatatccaacacatcttgcgcgctttcagtttttggcatacgtaccacatccacacccgcacgcactaccgaattcaaatccaataaaccaaattcagaatctagcggattaacacgaactacggtctcaatttctttataaagcggatgttgaagtgcatgagcgactaataaacgagcagaatctttttctttgagagcaaccgcatcttctaagtcaaacataatggaatctggtttataaataaagctattacttaacatggcggcatttgagcccggcacaaataacatacttcttcttaatttcatagcacagcctcccagttaatcgcttcatcagttgcacgcattgcagcagcttttactcgagcttgtaacacgcaatctaacgcccctttgtcttctacaatgacttgtgctgctgtaatgcctagttttgctaatacttcacgaactgtcgcttcaatttgttcaccaaattgttttgctactgagctattgatttcaatatcgagtgagtcaaaaggttgaacccgtacttgaacatcactggattccagtgtccctgcaacggctacttttgttattttcatagattttccttccgtatattgatgaataaaaatgtatttaaaaacgaccgcacttttgtaaataatttaacgtagtcataggcacaaactctgcgagttgagcccaatttttttcagccaaatgctttcgtactgtagaagcagaaataatgtggttgcttgctgtttttctaggtatctcgataacatttatttttggtgcattcatttcggcatccattaaccaataatgcatttggcgattatattcggcagtgacgggacaatttagctcagtaccaacaaagcgatgtgttattcccaaagcttgagcaatatgtaaacggaataacttcagatcaatctcaaaataactttcatctgtaattaattgatcttttaggaaataatttggaaatgttgcacgagaaataatatagtcagagccagaatgaagagtgatattggataaatcgaaaataccttgttgaatcatttcaaatcgttcagtgtaagaaaattgcgatgcgtcttcaccgacaataaataaatgcagatgatcacattgttgtaatgcttgctcaattaaataacgatgacctaaggtaaatggattcgcgttcattacaatcgagccaattcgattaccatccacacgcattttctcccataatgagcattgtttttgtaaacgcgtagcactattttctaataatactacataaggattggcatcagagatgatataaaaaccacaagatttgaacaacgttgcatattcgggttttgtataaataaaaaggtgtggacgttttagcgtgtaagctaaatcaaccaattcagtaattaattgcaaggcaacaccgctaccacgcaaagactcatcaatcgcaacacattttatgatattgcctgctaaaccgccacagacaacgatttgttcgttatcattatagccaacaacaaaatactcgatttgttcatctaatttaagcgcattttgatgtaaaaatgtctgaatgagagaaagttttttttgttcagtagaaattcgctcaaattgcatcgactctccaaaaaagaagaaaacataacatcactaccaagttagtagtatagagctattataagcgatgagcaaattacgatacaagataagctcatatttttcccaactttataatctaatattatcttcacactgcattatacattgaataatttataggcaatattggcggttattctgagttgtaaaaataaaccgcacttttgttgcaagcaaaaagtgcggtttaatttagcggaattttaaattatttcactaatccgccactggcttgtaaatcagcgtgataagaagaacgaacaaatggcccacaagccgcatgttcaaagcccatttcattggctttatcacggaattcatcaaattcagttggcggcacataacgggcaacaggcaaatgatggcggctaggttgaagatattgacccaacgtgagcatagtcacaccgttatcacgtaaatcttgcatcacttgcaaaatttcctcgttggtttcgcctaacccaaccattaaaccagatttggttgggatatttgggaatatttctttgaattcacgcaataatttaagtgaccattcgtaatccgcacctggacgaatttctttatataagcgcggtacgttttctaaattatggttaaagacatctggcggattatcttttaatttctctaaagcctgtgtaatgcgaccacgaaaatcaggcactaaaatttcaatcttaatgttaggattaagctcgcgcacagcttttacacattcagaaaaatgaccagcaccacgatcaggcaagtcatcacgatccaccgatgtgattaccacatatttaagtttcatatcttgaatcgtttctgccaatttttgtggctcttcaggatctggcggtaatggtttaccgtgagccacatcacagaatgggcaacggcgcgtacaaattgcacctaaaatcataaaagtggctgtgccatgattaaaacattcgtgtaaatttggacaagatgcttcctcacaaacagaatgtaatccgtgacggcgcattccatttttaatgctttcaattttagctgaacttgctggaagtttaattttcatccattctggtttttttaataaatcttgattaggatcgatattttttacgggaataattgaggtttttgccgcatcgcgatattttacaccgcgttccattttgaaaggcgtagacatagtattttcctaaataaaaatgcccaaattgggcatttagtttttataaaatgttataaagttgttatattatagcctaaaagattggcgaagtgtttaattaattttgctgaaacattatcgcaatcagctttatcttgattaacaaaatccgctaactgacacatttcaagccctgcataaccacaaggattaatataatggaaaggattaagatccatattaatattcaatgccaacccgtgaaaagagcaaccacgacgaatacgtaatccaagagaacaaatcttttttccatccacataaacacctggcgcatcaggctttggatagctttcaatgccatattcagccaaagttttaaccaccgtttgttcaagtgcggtaactaattgacgtacatttaaatttttatggcgtttaatgtcaataagcacatacatcacttgctgaccgggtgcgtgataggtaatttgcccaccacgaaccgattgcaccacagggatttcactacgttgtaaaagatgctctggtttacctgcttgcccttgtgtaaaaacaggataatgttgtactaaccaaatttcgtcttgcgtttcagcatttcgagtatcagtaaaatcctgcattttgtgccaaatttcttgataatcttgcaatcctaactgacgaacgataagggaattgntcatactaaataaccattttcacgccttcaactttagccagttctttatagagtgtttctacctgatcaaagttttcagcaataatatcaattgaaactgaattataagtgcctttactactgcgcttttcttttggaatataatcgcctttaatatatttttgcaccacttgtataagatcttgtgctaacccttctcgattaattcccgcaactttaaaagtcatttttgctggaaattccattaattccttgagttttgcataatcgttttctattgtcattttctttcctaaaaataaaataaatcaaaaagtgcggtcaattttcaaattctttttatgagaataaccctttcacagtcaatactaaccaatcccatagtttaccaaaaatacccgcttctcccacatcattcatcacttgtaaattggcacttgcaatatccttaccatccagttgataaaccactttaccaatcacttgaccttttactaatggtgcttgtaaatttttatctgctaattcataacgagctttaacctcactttgtttacctttagggatcgtaataaagtgatccattaaagcaccaagttttactgaatttttatcgccataataaaccctttgttctgaaatttctttaccagcctctaaagttttaaatgtttcgaaattagcaaaaccccattgtaaaagtttcttactttctacttcacgacctttgtaagttggcacacccattactacagaaattaaacgcatattgtttgatgtagtcgctgaagcgactaagttatatcctgcttggctagtatgccctgtcttcattccatcaacattgatagttttatcccataatagtccattacggttagcttgtttgattttattaaatgtaaagtttttttcggagtaaattttatattcttcaggtaaatcacgaataatatgcgcaccaataattgccatatcacgcgcggaagaatattgatttggatcgtctaaaccatggggcgtggtgaaatttgtatttttcaaaccaaattgttgaacatatttattcattgtttctacaaagttcggtacattgccagaaatatgttcagctaatgcaacagtcgcatcattaccagaaacaacaatcacacctcgatttaagtctgctacagatacttgtgtatttaaatctaaaaacatttttgatgaatcagggaaattacgcccccacgcactttcaccaatggtaaccatatcggtattatggattttgccttgttttaatgcgacaccaactacataacttgtcatcattttagtcagtgatgctggatattgacgttgatctggattaagtgcggtcaaaattgcacctgaattataatccatcaatacatacgtttgagccgtaatttgtggtggagttacgccaaactgcatatcctctgcagataccgaaaaagcactaagtgccacaaaacttgataaaaatgcgatttttgttgttcttttcaacatagtgtgttcctacaattaatttttatacgtataaacaattaatggcttattatttgccattttttgtaatttagttctcacttgtgccatttttgttttgtcatcaaaaggcccaatataaatttcatatttatttcctgagcgatttacttcagtctgaatattcgctaacgcaagttgcgtaattaatttatttgcttggctacgagaggttaattcaagcattttcaaacagtaaaattcggttccttttagagcatttattgacttagatgtgttatcaaaaagtgtgttagattttaatactaaacgatcggcagcttcctgagtttttgcttgtttagccagtgtttttgtggctgcgcctgataaattcccatttttagcaacgtgcaacgcctcaattcttacctgccctatgccgcgggaaattaagccaatttcttttgccgcagcgtgtgaaagatcaattaaacgtttatcactaaaaggcccacgatcattaatacgtacgataactttacgattgttatgtaaatttgtcactaaagcataagaatttattggcaatgttttatgtgctgcagtaaattgttttgagttataaacatcgccacttgctgttttgcgcccatcaaatttaagatgataataacttgctaaaccttctttaatataagatttggcttcattcccacttttagtggtataagtttgcccttttactgaataagtccttggtgcaggcatttgagttgcgatagaaagattatcccctcgaataccatacattttttgcgtatcagcctgtgcaggaaaagctacgcttatcataaatagcaaaagtgcggtcaaatttaacccagtttttaatttcataaaatattaacgcttttcatttattctttctttaagaaagaaaaaatgaaattagctccttttcataaattgacttttatgcgtatgaatagacatcagtaaaccaaaacttgccataatcgcaacataagaggtaccaccataactaaataaaggtaatggcacacccacaacaggcaaaattccgcttaccattccaatattcacaaatacataaacaaagaaaattaatgttgttgcaccagcaagaatacgcccaaaagaagtttgagcatttacggcaatcattaaacctcgcacaataataaacaagtaaatcgccattaaaatcaaaaaaccaatcattccgtgctcttcacccattaccgcaaaaataaaatctgtatgaggttcgggcaaaaattctaattgtgattgagtcccctgcatccagccttttccgcttaatccaccagaaccaatcgcaatctttgattgtaaaatatgatagccagcaccgagaggatctttttctgggtccaataatgtgagaacgcgagtgcgttgataatcgtgcattagatataaccacatgatcggaataaatccagctaagccaatcactgccgctaaaataagccaccagctcattcctgctaaaaacacgacaaataaacctgacgcactgaccaaaattgatgtgcctaaatcaggctgaatcgccacaagcaatgttggcagtagaatcattgcaatcgctataaatgtttcacttaatttaggtggaagcgggcgattacctaaatacaccgccaccattaatggcacagcaagttttacaatttcagagggttgaaaacgaataaatccaagatcaagccaacgctgtgcacctttacttgtcgtaccaataacatctaccaagatcaataacacaaaaccaattaaataaagataaggtgcgatgcgttggtaaaatcttggtggaaattgagccattaacagcataacaataaatccaagtaagacctgaataattcggctattaaacatcgtttcgctggcacctgatgcactatataacaccagcataccataagcagttattgcaagaagtccgataaacagccaaaaatcaatatgcaaacgttgccaaacacgcaaccaaaaagggattttatcttccatttatttgttcgctctcttgtgacaaatcttttttttgctgaataggtacattatatttttcaacttgtggtaaacgctgatttaaatagtaatccatcactttacgtgctaagggtgcggcattacttgaaccaccacctgcattttctaaaatcactgttacaactaatttaggattatcataaggggcgtaagcggtaaaccaagcgtgatcatgcaattctttttttaagcctgccgtattatatttttcattttcctttaaactaaacacttgtgcagtgccagatttccctgcaacacgataatttgcatctgcaaaggcttttcgcccagttccatttgcagcattaacaacattgtacataccgcgtttcgctgcctcccaagctgccactttaggtgtattaatatcaggataaagtaacggatcttcataaggctctaatactgcaccttcaattgctttcatcaaatgcggtgtatttactttgccattattgaccaatattgtcgtcgcttttgctacttgtagtggtgttgccgtccaataaccttgaccaatcccaaccgaaatcgtatcgccttgcacccaagggcgtttataacgtttttgtttccattctcgagttggtatattggcagccgtttcttcttgaatttcaatccccgttggcataccaaaaccaaaatccttcatccaattagaaaggcgatcaatacccatattataagccacttgataaaaataagtatcagaggattcagtaatcgctttattcaaatccgtatccccgtggcctgtttttttccaatcacgaaaacgttttgtggaattaggtaatacccaatatcccggatcaaaaatcgttgtgtttggtgtaatcacattttcagtttgtgcggctactgcaataaaaggtttgactgtcgaagcgggcggatacgcaccttgtgtcgcacgactataaagtggacgagcaagatcatttaataaacgtttataatcttcggaggaaataccatcaacaaataaattattatcataacttggtgtagataccatcgctaatacactactatctttcggatcaagcacaactacagcaccttttagtcccgataaaagttcagtaatataacgctgtaatgccaaatcaatggttaaatgaatactttttcccgccacagcaggtcggctacgcaaagtgcggattactttgccgcgattattaatttctacttcttcaaaacccgtggtaccttgcagtatatcctcgtaataacgttcaatacccaattttccaatatcgttcgttcccgcataattcgcgaatttatcctctcgtttcaaacgttctacatctttatcattcattttacctacatagcccaaaatatgcgccattgtttcgccatataaataatggcgtttgaaataaggacgtacctctaagctcgggtattggtagccatttaccgcaaagcgtgaaatttgttcttctgttaaattcggctttaataaaatcggtgtataacgcgttccgcggcgacgttcctttttaaaattttcaatatcgttatccgtcaatcccacaatatagcgtaattcatctaaagtgcggtctaaattttcagttttttctggcacaatgtataaaccaaaaaaagtaagattttcggctaataatttgccgtaacgatcatagattaagccacgtgttggcggtaaaggtaataatttaattcggttaccattagaacgcgtttggtaagtatcgaaattaacaatctgtagctgataaatattggtgaataacacgcctgttaagagcagaatccccaaaaaagccactaacgttcggcgtgcaaaaaggttacgctccgcttttttatcgcggaacggttcgtgcgttggtgtattgaagaatttttttaaattcatctgactaaaataaggatgtattattctcgatgataaggatgattagtggttagcgaccacgcacgatacaaactttcagccaccacgacacgaacaagcgggtgaggtaatgtcaagggagaaagcgaccaactttgctctgcagcagctttgcattctggcgaaagcccctcaggcccaccaatcaataaacaaacatcgcgaccatcatttttccacgcttctagttgctcagctagctgcggcgtcgtccaaggtttaccaggaatatctaacgtcacgactttgccttttccacaggccgctaacatcgctttaccttcttgttctaaaatgcgtttaatatcagcattttttccacgcttgcctgctgggatttcaattagttcaaaaggcatatcttttgggaaacggcgttgatattcctcaaaacccgttgtaacccaagaaggcatttttgttccgacggcaattaacgtgattttcacaagtcatccttatctaaaaagtgcggttattttttaccgcactttactaaaatttacgcccaaagtttctctaattgatacatttcacgggcgtcacgttgcatgatatgtacgatagcttgaccaagatccaccacaatccaatctgcagtatttttaccttcttcgccaaaggtttcaaaacctgcttttttacattctgtaattaaattatctgccattgcagaaacttggcgactcgacgtccccgtgcaaataatcatattatccgtaatcgaggattttccacgtacatcaaaatgtacaatatctgttccctttaacccatctaaggtttccatcaaaaattcaactaacgccattttgttctcacttagcaataaaggtgcggaattctatcattgaataccctcttgcgcaaaatccacgcaaaaaataagcgcgaaattaaccgcgctttttatgtctaaattgaaattatttttactatgctgcccataataacactgccaataactgtggcgacattattcgcaagaacatcaccaatggatacacagttgcataagaaagtgctgcagcaccgttatcttctttaatttcattcgcaaatgctaaagcgggaggwtccgtcattgaacctgcaagtaaaccgcatattgtgaggtaattaagttttccatataagcgtgctatagtcccaacaataatcaacggcacaaaagtgataaaaataccgtatcccatccattcaagtcccgaaccattcactaaagtatcaaagaaacttccacctgattttaaaccaacaaccgccaagaaaaggacaatcccaatttcgcgcaatgccaagttagcacttggtggcataaaccagtaaagtttaccaatcgtgccaattctcgctaaaatcaacgcaaccaccaatggcccgccagcaagccctaattttaacgcaacagggaaacctggaatatagaatggaatcgaaccaacgagtacccctaaaccaataccgataaacactggtaacatttgcacttgaagtaatttctgttgtgcgttaccaataactgaaatggcctgatttagtacatcactgcgtccaaccatatgtagcacatcgccaaattgcagtgtggtatttcccgttggaactaactcaatccctgcacgatttaaacgtgaaattacaaccccatatttttgatgaatgcctaacgcacggatctttttgcctaatantttttcantcgttaccaccacacgctcggaacgaatttcgccactataggcaacggttggtgcatcaacttcgtgtccgataattaaacgcantttagcaagcgaattatcatcacccactaattgtaaaatatcgttggtacgaatctcagtacttgcctttggaacaatttccatatcatcgcgttttaaacgtgaacatacgacttcttcatcgctaaatcccggaatttgaattaacgtcagaccatctagattttggttcgtcacttttaaagaaatattatgtaaactttctttatcttggctgctctccgcattaaaacgagcagcttcatcgtccactttgacgttaaaaaacaagcggattaaccacattgcaagcaaaataccgcaaatcccgaatggataagccattgcataagacacccccatagttacagtggtttgaggcacccctaattctgctaaaatttgctgccctgcccccaacgcaggcgtattagtaacagcaccagaataaatacctaaggcaatatccagtggaacatccgcaattttatgtacaagaaccacggcaattgaccccagcagaataatcaaaatggcaaaggcatttagctttaaaccagattttcgtaaagaagaaaaaaagccaggtccaacctgaataccaatagtataaacaaataaaatcaaaccaaattcttgcacaaaatgcagcgtatgcgcatccagtttcaagccatattgattagtgaaatgggcaacaataatgccgccaaacagcacgccaccaatgccaagcccaaccccgcggatcttccaatgcccgatccataagccgattacggcgacgagggcaagaagactaatcgtgatcgcaatatcactcatattgaccccttaaaaatgaaatttaactccttcggattatatccaagttgttttttgaaaaccttaaccaaactcaaaaaatgatacgttcgtcacattttttcttgcgaaattgagcatagcctctacaataccgaaaatttttgacccttttacaaaaagtgcggttatttttcaccgcacttttatctcggatggaatatttatggattacagccaagaagctattacttctcttatttggattttacaaacgctagccatcacctcagtcgtctttagttttggcatttttcttttggtgcgttttacccaatggggaaaacaattttggatgtttgcaggcggttatctttcacctaaacgtagcattaaacctatcttattctttctgcttattgttgcaatgacattacttagcgtacgtatcagccttgtaaattctgagtggtataaaaatatgtatacctcattgcaagaatttaatgaacatgtattttggcaacaaatgggcttattctgcgtcatcgcagcaagttctgtttcagcagcattagtaagctattatttagagcaacgtttcgtcatcaactggattgaatggcttaacgagcagcttgttaataaatggatggcacatcgcgcctattacaaaacacagtatttatcagaaaatcttgataaccccgatcaacgtattcaacaagatgtgcaatcttatgtaaaaaccacgctttctttaagcactggcgtcattgatgcggtcacctcgatgatctcttacacgattttgttatggggattagccggtccaatgatagtgcttggtgtagaaattccgcatatgatggtatttttagtgtttggttatgtcattttcacaaccctcatcgcattctggctcggtcgcccattaatctcattgaattttattaatgaacgcctaaacgcaaactatcgttattctttaattcgcattaaagaatatgctgaaagcattgctttttatgcaggcgaaaaagtcgaaaaaaatcagctttatcagcagttcaacgccgtcattcacaatatgtgggtcattatatttagaacactaaaattttcaggatttaacctagtcgtaagccaaatttctgttgtttttccattgttaattcaagttggacgttactttgaaaagcaaataaaactaggcgatctaatgcaaaccttgcaagtatttggtcagttacacgcaaatctttcattcttccgcagtacttatgataattttgcaagctataaagcaacgctagatcgtttaactgggttctgttatgccattgaaaaagcaaataataaatcacaaacacagatccacaatcatccaacagatgtgattttcaaaaatttaagtattcaaaatccattaggtcatacactaattaaacatctaaacattaccttaccgcaaggaacaagtttgcttattcaaggaaaatctggagcaggaaaaaccacgcttttacgcaccattgcggggctttggagctatgccgagggggaaataaattgccctacgcacaatcagcttttcttgtcacaaaagccgtatgtgccacaaggaaatttaatgtcagcattagcttatccaaataacgctgacaatatttcacatacacaagctgtagaaatattaaataaagtacaactaggacatttggctgaacaattagaaaaagaacaagactggacgcgtattctttctcttggcgaacaacagcgtttggcgtttgcacgattaattctacacaaaccagcggtggcatttttagatgaagccacagctagtatggatgaaggtttagaattttcgatgtatcaattgttacaacaagaactaccacaaacgacaatcatcagtgtgggacaccgttcaacccttaaaaccttacatcaacaacagttaattctgcaagacaaagggcaatggcaagtgctataaaaaacgctaaaaaacactgtaatcgcaacgctttttttgatacatttagtgcaattttttgtatgtttgacaaagtcattttctactttttgtcaaacaaaactaactttcattttaaacggtataattatgttatttaaaaaaattcgtgggttgttttcaaacgatctttctattgatttaggcacagctaatactttaatttatgtcaaaagacagggtattgtacttgatgaaccctctgttgttgcgattcgtcaagatcgcgtaggcacattaaaaagcattgcagctgtgggtaaagaagctaaattaatgttaggtcgtactcccaaaagtattgtagcaattcgtccgatgaaagatggcgttattgcagacttttttgtgacagaaaaaatgttgcaatactttatcaaacaagttcatagcggtaattttatgcgtccaagcccacgtgtattagtatgtgtgccagctggtgcaacacaagtagaacgccgcgcaattaaagaatcagcaatcggtgctggtgcacgtgaagtatatttaattgaagaaccaatggcagctgcaattggggctaaattacccgtttctactgcagttggttctatggtaattgatatcggtggcggtacgacagaagtggctgtaatttccttaaatggtatcgtatattcttcttccgtgcgtatcggtggtgaccgtttcgacgaggcgattatttcttatgttcgccgcacttttggctcggttatcggagaacctaccgccgaacgcatcaaacaagaaattggttctgcttatattcaagaaggtgacgaaattaaagaaatggaagtacacggacataatttagccgaaggtgcgccacgttcatttactttaacatcacgtgatgtcctagaagccattcaacaaccattaaacggtattgtagcagcggttcgaacggcacttgaagaatgccaaccagaacacgcagcagacattttcgaacgtggtatggtattaactggtggcggtgctttattacgtaatattgatattttactttctaaagaatctggtgtccctgttatcatcgcagaagatccattaacctgtgttgctcgtggtggtggcgaagcattagaaatgatcgatatgcacggcggcgatatttttagtgatgaaatttaatcagaatatgaacaaaaagtgcggttaaaaataaccgcacttttcctttcacttttttcattcaacaagagaaagtttaatgaaacccattttcggcaaagcccctcccctaggtattcgtctgcttatcgctatctttgcatctattgccttaattttagctgatggacgtaatagctcaataacgaaagcacgtagnnnaatggaaacggcaataggcggtttatattatcttgcaaatagccctagaagtatcttagatggcatttcagaaaatcttgttgataccaataaattacaaattgaaaacaaagtactacgccaacagcttttggaaaaaaatgcagatttacttttacttgatcaactcaaagtcgaaaatcagcgattacgtcttttattaaattctccgttaagaaccgatgaatacaaaaaaattgccgaagttcttactgcagaaacagatatttatcgccaacaaattgttattaatcaaggcaaaaaagacggtgcttatgtaggtcagcctgtcattgatgaaaaaggcgtcattggacaaattatttccgtgggcgaaaatactagccgagtactgctactcacagacgtaacacactcaattccagtgcaagttctacgcaatgatgttcgtgttattgcgagtgggactgggcataccgatgaactaagcctcgataacgtgcctcgttccgttgatatagaaaaaggcgatcttctcgtaacctctgggcttggtggacgttttcttgaaggctatcccgtagctgttgtacaaagcgtttcacgtgatagctctaattactttgcaatagttaaagctaaacctttagctttattagaacgtttacgttatgtacttttactttggccaagtaacctagatatatcaaaagtaaaatcaatatcgccagaagaagttcgcaatctggtgcaaaaacgtttagaaagccaagctaatgaagcaaattatagagtgaaaaaaacacccttaacagaaaaagactttctagaaaatgaagaaaaaaccattattgaaccagatattccaacagattttcttcaaaatgaagaagatcttcccatagaacagcaagaagaaaggatagaagactaatgcaaacacgatttattttacaatggttcactattttaagcttctttgttattgcctttgtattagaacttgcaccttggccagttggtttccaaatgctaaagcctgcgtggcttgtacttgtattactttattgggtattagctattcccaataaagtaagtataggctggtcatttttactcggattaacttgggatttaatattaggctctacattaggcgttcacgctcttgtactttctacgagcatgtacatcattgccaaaaactatttaattctgcgaaatttatcactttggttccaaagtttattggttgtacttttcgtcttcattataagattacttattttcttagttgaattttcactccatactgccttttttcattggcaagccatcttgggcgcattcgcttctggtttactatggccgtgggtatttttattaatgcgcaaaatacgcagaaaagttaaattacattaaaaaagagagataactctctcttttttatgatttatgaatgtttcaaacacctaattcaatggcttattgctatccagtaaagaatcacattcccaaccgatatactctcccgaaaattgttcagccaatttttcaaaacgttctacttgttcaaaaatttcgctattttctaatgaaatttcttgctctaattttaccaagaaataaggttcgtcatcttcattaaactgaatcgcttgtgcagaatattgtaatgtcgtgaaagaataatcccctaaactaagctcatccataaaagggaacattttctgctcttcatcaaaatgaaaactatgctctactaaataggtatcacttaaattacgacctttactttttaataaatcaagcaattcttccgttgcatttaacttaatctccaatggagaagcgagcaaaaagtcaaaataagtatcccaaattaaatccttttgcacattaatatctttaacaaaatcaatttgttgtaaagtttctacaataagattttcatgcttacaataaaaatgtatttttatttgagaattacaaataaaatgccccgcaaaaaatacatttggaagtgcggttagttgtgtcaaaattttaaatacacggttaattaacttatcgtattcaacttctgagggtaaacccgtttcatcatcagcctgataatcaatagtaaactgcactattttatcgagacctttaccgtgatatttttcaacatcttcaatatttgcggtaaacacggcaggcataccattcacagtagaacgataattctgccaatttgccatatccatttcgctttcctatttaaattcagcccaaatcggtgcgtgatcagacggtttttccattgctcgaatatctaatgcaatgcccacatcgacacatcgttcagctaatttttggcttaccaaaatatgatcaattcgtaaacctcgattatcatcaaaacctttagaacggtaatcaaaccacgagaatttatcatttgctgttgggttcagcttacgaaaactgtcttctaatccgtaatcatacaaacgttgataccacgctcgttcttccggtaagaaagaacatttccctgtgcgtaaccaacgtttacgattttcatctccgataccaatatctaaatcacttgggctaatattcatatcgcccataattaaaatcggattcgatttgtcgtgttctttttctaaatactgttgaagatctgcataaaatttctctttagctggaaatttagtctcgtgcgcacggctttccccctgtgggaaatagccattaatgacagtcaataagccaaattcagtttccagatcagccataataatgcgtttttgtgcatcttcattgtcagttggaaaaccacgacgaatcactttaggttcttgtttagtcaataatgccacgccataatgacctttctgaccgtgatgaaatacgtgataacctaagttttctgtaatttcatagggaaaagcctcgtcagcaactttaatttcctgtaagccaatcacatctggctgatatttttcaataatggcttcaagttgatgtgggcgagcacgtaacccatttatattgaaagaaataaatttcatttttgttcctattaaagagtgaaattggctttattatacagagatttctattttgataaaaacggctttgtcagataaacctgaatttgctcaaatactgtaggcttaatccaaaattgaccttgagaaggtaaacaagtgaccgaaataaaattatttagataatcaaattccaattgagtagcgtgcaaataagtgcggtcaattttttctgtgtttttaccataaagcccatcgcctaaaatcgggctacctaaacttttcatcgcaacacgtaattgatgcgttttccccgtttgtggttttaaaataaataaacgtaaattaggctcacaacttacactttcaaaacgcgtaattgcgggattgtcttttgtttggcaaagtttccatgcgccttctcgagctttcttcatatccccgataatcaaaccttgtttctttttaggcttttggttacttaatgccaaataagttttatgaattttatgttcagaaaaaagtcgtgaaaattcagccgcactttcagcatttaacgccaganttaacaaacccgaagttactttatctaagcgatgaaccaaccatactttaggcacattcagttgttttgcaacaagttctgttaagccttgttcttcttgatctttatgaacgctaataccctcagacttgttgataataataaaatcgctatgttgataaacaacctcgatttccatcagatttgctcctttttgtaaattttatttttaccgagaacaatatcttttaccgaactaagtaattcctgttgaatatgtgacagttttggtttttcgtttaattgaaatgctaacggacgacaaagttccattgctttcacgcctaatctagcagtgagtaatcccacaccaattccttgagcgatacgtgtagataattttgctgtcacatcttgagaaagccaatccattccaatatcttgtgccacttcggttgctccagcaaaagcgatattgaccaataccattcttaacaatctaatacgtgnaaaataccctaattcaatcccataaatttcagcaatcttattcattaatcgaagattgcgccacgcaatnaaaaacatatccactacagcaagtggactaatcgcgacaatcacagctgattcagctgccattttactaatcaattttttagcttgtgcatcaaaagaagacaaaacatgacgactgaataaatgagcaatttcttgcgccgaataagcttcatttaattggtgttgccattgaattaccgttggagaatcattttccaaacctaaagattttgcaatatctaagcaaagaattttacttttttctgcgttatgaacggaaaaaacatcaccattttttaccgcactttctaaccaaatctgctgactttgttgttgccattgctcacgtttttttaaacgaactaaacgtcgccactcacaaataatctctttaatacccaataaaatgataatcaaactgactaaagcaaaagcaagataaatccattgatgtttttgatagctatcccaaatccactgcacggattgcgcaaccgtcgccaagccaaataaaagtgcagtaaattttaataaagtttttctaaaactggattttggtttcaatgcttgttcaagttgagcatcaagtaactctccgtccaacgcttcatctagctttgcttccatattatggaantcttgcttgggctgatagtgttcttcctctacattaactgaatgttcaaaaatttgtttttccattgcctatcccaaaaaataaccccactaaatagtggggttataaagtcaaaaatcaatcattattcatcacttgnaaagatagaaagtaatcttaataaactcaagaataaattgtagattgaaacatagatgttcacggttgcgcgaatgtaatttgtttctccaccgtgaataatattactggtttcatacaaaatggtcattgttgagaacactacaaataatgcactaattgcgaccgataaagcaggaatttggaagaagaaactcgccaccataccaagcaataacacaataaataatgcgaacattgcgcttgataagaatgacatatcttttttcgtagtcaatacataagcggaacacgcaaaaaatacgatagcagttcctgcgaatgcaagcataatcaaatcttccattccacgtgccacatacatatttaaaattggcccgatggtgtatcccataaatccagtgaaagcaaaggccgccaaaataccagcagggcgatcagctaatttattggttaagaaaagtaagccataaaaacccactagtaacacaataatatttggataaggcaagtttaagctcattgaaataaacgcaacaaccgctgaaaaagccattgttaatcccagtaaaaaatacgtgttacgcaacactttatgtgtgctgagtaacgattctttttgagcatccacaataagacgtgattgcataaaagctccttgtaaaataaataaaaagtcttctgtaaagtaagggctagggataaaaaagtcaatggtattaatggaattaatttcatcaaaatgaataaattatcatcatctaaagttaaatcatcaaatttctatttacatcaataaaatattcattatactacgcgcatcaatcacggaggaatggtcgagtggttgaaggcaccggtcttgaaaaccggcgagggtttacgccctcctagggttcgaatccctattcctccgccatcagaattaagaaatccctaagtcacaaggcttagggattttaactttgtattacgttatttggtcaatccattcactagtgaaataacagtctgaatatcgctatcagacaattttccttctttcacaaattttacttttcccgttttgtctaacacgataattgcactatctttagaatttaatccccaagcattttttaccgcacttttatcatctaacacaacttggctatgtggattttcctgtttgccttttttcgcaccattttttacaaacatacctgtaccaacaatcgcatcatccgcattaataatagtggttgtttggtattttacaggattaaaatgggatgcttttatcacatcaatcatcgactgattttnctcttttgcagccgttctacccgctaaatgatgaacaacacgcactttacccgctaattccgcagaaccccaaggttgaaacacagtatcttttccagaaagcacaatttcaccatactcactcactttgaccgatggtaaagattgttctaattgcaaattgtgtgcccaagttgaactactaaatatcacgccacaaactaaggcaagaatttgttttttcatacattttcctcaaaaatttatcaaaaactttcacgctttggcgaaagacatctttttgctatactcgtgcgcctattatatgtaatcaagaaggaaaacccaatggatcaaatgcctaattgcccaaaatgtcaaagtgaatacgtttaccacgattcaattaattttgtttgccctgattgcggtaatgaatgggataataatgaaattcaagaatcagatgacgatcaactaatcgtaaaagacagcaatgggaatttgcttgcagaaggcgacaatgtacttttgattaaagatttaaaattaaaaggttcatcagaagtattgaaaaaaggtacaaaattcaaaaacatccgcttagtaaatggcgatcataatgtcgattgcggcaaaatcatgttgaaatctgagtttttgaaaaaggcttaatcgaaaaaacgcggtctaaatagaccgcactttgcactttaaagaaataaatttatttaataatatcaatcacttctctgactaatcgtccaatttcatcccaattattggattgaatcaattttttctccacaaaccaagagcctccacaagcaacaatattaggaatagcaagataatcccttatgttatgaagccctataccaccagtcggcattatctgtaattgagcataaggaccaagcaatgctttaatcattttcactccgcctgaagcctctgcagggaaaaattttaccgccgaaattcccatttctaatgcaatttcaattgccataggattattcacccctggtgttattggaaaattcaaatcttgacataatttcacaatttttggatttaacccaggagtaaccacaaaatctgctccgctacttttagctaaaactacttgttccgcagttaaaactgtgcccgcagcaattaaaaagtcaggtctatttgcacgcaacaaacggatcgcatctgccgctgcttcagagcgaaaagtaatctctgccacagataaaccatttttagccaacgtatctgctagcggcaaaatatcgtctgcattatccaacgcaattacaggcacaattttgagttcacgaagtttttcaataatttgttgagttgtgtatgacatttttttaatttgctcctattagactccactatacgcagaaaaaccgccatcaacaggtaaaaccacgccattgacaaaagcagaataattttcatctattaagaaaagtaatgcaccgagcaattcttctgactcaccaaaacgtcccattggtgtgttagtgaggattttatttgctctatctgttggttttccttcagtatcaaataataaagcgaggttttgattactaactaaaaatcctggtgcgatagcattacaacgaataccaactttcgagaaatatacagcaagccattgagtaaaattactgattgcagcttttgcaccagagtaagcaggaatctttgtgagtggcgtaaaggcattcatactggaaatattaataatatttgccccttgtttaccaagcatatcttttgcaaaaacttgggttggtaataatgaacctaagtaattgagattaaatacaaattctataccagatttatctaaatcaaagaatgttcttgtcgtttcatttaaatcaaattgatggaactcattatctgttgtcgcttttggattattcccaccagcaccattaattaaaatatcacaagtgccaaaatcggtttcaatttgatttctcacttctttaatattttcaagttctaacacattagttttataggcttttgcttttcctcctgattggttaatttcctttgctactttgtctgcagcctcgaaattcaaatctaacaaggcaatattagctttagtatacgctaattgcttagcgagaaatgaacataacactccgccagcccccgtgattataattagtttattttctaagttatggtttgctgcaatattcatagtaaactccattaattaaattcagattgaagatgagaaattgcgactttatctataatcgcacctttatgttgaatgacgataccagcaatacgattgccttgctgacaacaaatttcgagagatttatttcgtaaataaccgttcagaaatccagcattaaaagaatcaccagccgaggttgtatccactacatttaaaataggttcaggtatcacttgcccatattgagataaatacctatctgaaaaaatagcaccattcttaccgcacttcacaatcacttttggtataccaattttatgtaatcgctctaaagtatccctagatgttttatctttccataatgcttgttcatcatcaaaagtcaccaacgctatattgacactaggcaaaagctgcaaataacaatcttgtgcttcttctaatgaatcccaaagttttgggcgataattactatcaaaaacaatttctgtgccttttttagctaaagaagataattgttcaattaaaaaagtgcggtcatttttaggtaagattgctaatgaaataccacttaaataaatcacatcaacttgctgaagttctgcaataaccttagcaaaatccggatgttgaaccatataacgtgctgcagattgattacgccaataaaggaacgtgcgttcgccttgagcatctaattggattagataaagacctggttggtgctgttcatcctgtaaaacccaatttgtttggatgccatcagcttgccaatatttaagcatttgcttgcttaaattatcggttcctaatgcagagacataatgaacttgaatctcttttgatgaacttactcgactaagataagttgcagaatttaaggtatctccaccataactttgccacatttccgcaaagggtttcccattgagttcaatcatacactcgccgataaatgctatttttttcatgatgtaacttcctaataaatcaagataaccaattcattggaacaattacaatttcaggaaaaaatacgatcaacatcataataattgcgtacacaaataagaatggagcaattcctttggataatgctcctatccctaattttgatatccctgagcctacatacaaaactgttcccacaggcggtgttattaatcctatagataaattaatcaccatcatgattccaaaatacgcaatatcaatattatatgctcttaacactggtaataagactggaacaaagattaataccgcaggaattaaatccattacacatccaacaagtaataaaaatagcattataataaacattaaaattgtcggactatcagttaatcctttaatcgtttggactaattctgttggaatttgagcaactgtaatcgcaaaagcagatatcattgctgatgcagcaacaaacattaccattgatgttgttttgatggtaccaatgaagacgtcttttaatttagaaaatgttaagcctttataagcaatacttactatgccagcataaattgcagcaacaactcccgcttctgttggagtaaaaatccctcctcttaatcccacaataataatgataggtaataataaaggccaaaatgcttttttaaaagcaacccatctttctttgccagtttgttttctttctagacttgtatcattatttctatacaaaattttccaagtaacccataatccaacgaccattaataagcctggtacagttccccccataaataatttagtgatggatgctccagcagtaataccgtaaatgatcataggaatgcttggaggaataacaactgaaataatacctgcagcacaaattaatcctgtggaacgagcaccatcatattttttagaaatcatcataggaattagtattgcacctaacgcggccgtatccgctaccgcagaaccagataaccctgcaaatatcaacccagaaatgatcgcaacataacctaaaccacctttaatatgaccaaccatacttgttgcaaaattaatgattcgctcagaaattccaccatgcttcattatttctccagtaagcataaagaaaggaatagccatcaaaggnaaattattcgttcccatcacaaagttttctgtaattaattgcgtatcaaacatatcaagatgatatagcataatactcgcactcaacagcattgatagtgctacaggtacaccaagaaataacaataagaataaactacacaaaataatagtaacattataagctcctatttatcagaggattctttatagtctttaatcatgctaaacatgacaataaaaaagtaagatacggcagatataacagcagctaaatataaaaaagatgnagatatacctgtagctggcatttgttgagtataggtcaaagacatcagttgtaatgcaccataagctataaaaatcattgcaatcagaacgcatatatttgcaactattaagactatttttctatactgctcaggcaacgcaggaataataatatcaacagtaagatgagctttatccttggcnacaagtataatcccaaagnaaatcatatatacaaaacaaatcctagaaaactcttcagaaaatgcaattccagaatcaaagaagtacctcaagacagaattaaaaaacacgagagaaatcataataactaatgccaagatagaaagatattctaatgctttgtctaaatactttgctattttcataaaacaagctccttctttatcccccatgagcaatttataaaattgaacataggggatcttattaattatttagcttcgttaattttttggactacatccttagcccaatcatattttttataaaaactatcataaagcaccttagatgcattcaccatgtcatttttaaatgcttcacttggtacgataatttcatttccatgtttagctagataatctttaacttctaattctgttttaattgctaattcccactctttctcttgatacaatttagctgctttttcaaaaataatttgatcttcttttggaattttattccaagtttttaagctaatttgtaataatcctggagagaaaatatggttactttggataatatatttttgtacttcatataacccagagtctttaattaacatatacggattttcttgaccatcaattaccttttgttctaatgcagtaaaaacttcactgagcggcatgctttgtggatttatattcattgctttagcccaatcaacaaaaagtgaattcagcggaactcttaaacgtaaacctttaaaatcgtcaaatttctctaattttttattagatgaaataacacgaaatccattcataccataggcaagtaatttaattccatacttctccattttttgaccaattttatttgcgattggagattccaatacttttttagcctcttgattatccttaaataaataaggccattcccaaactccaaaaataggatctacattttgcaataataaacctgtaatacctgcttctatagtgccattacgtaatccatttacaatttgatcttcaccgccaagttgattattaggataaagtctaatctcatatttatgatttgtttcattttcaattgttttcttaaaatattcctgtaatgcaatatgtgatggatgaatatcagaattataatgtcctaacttaataattgtttttgcaaatgcactgctactaaacaatatacttgaagcaagtaataatttacctaagcctttaattgatttcataactttctccttattgattatgttttttagaaaactgcattaatttttaaataattttctggatgatcagataaatcagaaataaaactaggaatttcttcaaatttgatacacttagtaatgatatgagatgcattaattttattagtagcaagcatatccaatgcctcctcaaattcccccttgcttgttctagaaccataaatattcaattctttaaaggtaattaaatttgttggtaatggagtttctgtttttggccatcctgttaaagcaattcttcctgcaaaggaggcataatgcagagtatttttgatagaaatattagcaccagatgcctccataacaacttcagccatacgaccacttgtaatttccttaattcttttaatgtcatcctccttatgcggatttacaatatgttcaattcccaaggattttgcatactcaagacgttgttctaatatatcaactaaaattgggattgctccatattgaaccgctgctaatgcagccattaatccaattgcaccagctccaataattactatgtgttcccctgattttaaagttgttctatgtaaagcgtgtaaagctattgttaaaggttcagctaaaggtaattgatgaatcggtaggttatctgggactttagttaaaagatgagcgggatgtctaattacctcttgcatacctccatcaatatgaacaccaattacctttaatgattcacaacaattggttctaccaattgaacaaggatagcattgaccacaacaaacataaggatcaacaattactcggtctccaacccttaccccatctgacataccaattccactttcaattactctccctacaatttcatgcccaagtattcttggataagttactaatggattagttcctctatatgcaccaatatcagaaccacaaatccccattgattctacctgaataagtacatcattatcacttttctcgggataaggcacttctttaacaactacattgtttggtttttctaaacatattgctttgattcgctccttcatttttagactccttatatgccattgacagaataaaattacttgttatgtttaactatgatatgattatgaaacataaaaactctttttggaataccaaatatctatttttgtgagccatatcacaaaaataaaaaattggaataccaatttaaggaaaaatatggaaaatatagtaaatagaacatatacccgaataggtcaattgctaaaacaagatatttctcaaggaatttatagcattggagacaaactccctacagaacgagaaatttctgaaaaatttggtgtaagtagaactattgttagagaagcaatggttatgttagaagtagaaaagttagtagaggtaaaaaaagggtcaggcgtttatgtagtaagaacccccgaatcaatacatatggaacattcagatttaccagatgtaggtccatttgaacttttacaagctagacaactattagaaagtagtattgctgaattcgcagcgttacaagcgactaaaaaagatattttaaatttaaaacaaatactgaatcgagagaaagaattacttactcagaatcaagatgactatagtgcagacaaagattttcatttggcacttgcagaaattacacaaaatgatgtgttagtcaaattacaagaacaattgtggcaatatcgctttaatagtgcgatgtgggcacaattacattctcgtattttacaaaatgattatcatcatttatggatagaagatcatcaaacaattttatctgctattcaaaagaaaaatgctaatgaagctagaaaagctatgtggcaacacttagaaaatgtaaaagtaaaattatttgaattatctgatgtagaagatccacattttgatggatacctattcaatacaaatccagttgttgtaggtatctaaatacttgtaataacataggagttaaaaatggaacaagcatggcgttggtatggaccaaaagatcctgtttctttatctgatattcgtcaagcaggcgcaactggtatagtcactgcacttcaccatattcctaacggtgaaatatggggtattgaagaaattaaaaaacgcaaaactgaaatagaaaatgctggtttaagctggtcagtagtggaaagtgtaccagttcatgaagagattaaaactcagactggaaattatcaaaaatggattaataactacaaacaaactcttcgcaatcttgctcaatgtggaattgacactgtttgctacaattttatgccagttttagactggactcgaaccgatcttgcttatganttaccagatggttctaaagcattgcgctttgatcatatcgcttttgccgcatttgaacttcatattttaaaacgtcctgatgcagaaaaaacctataatcaagaagaacaagttgcagcaagaacctattatgacaatatgtcagagcaagatatagcgcaattaacgcgtaatattattgcgggcttacccggtgcagaagaaggttacactcttgatgaatttcaaactcaattagatcgctataaagatatttcatccgaaaaattccgtacgcatttggcttattttttaaatgagatcgtacctgttgcccaagaaataggaatcaaaatggcgattcatccagacgatcctccacgcccaatcttaggcttaccacgcatagtttcaactattgaagatatgcaatggtttgtagaaactcaaccattaccagcaaatggttttacaatgtgtacgggttcttatggcgtacgttccgataatgatctcgtaaaaatgactgaacaattcgctgatcgtatttacttcgctcatttacgttctactcaacgtgaaggtaatccactaaccttccatgaggcagctcatctagagggagacgtagatatgtttaatgtagtaaaagctttattaaatgaagaatatcgtcgattaaatcaaggagaaacgcgtttaatcccaatgcgcccagatcatgggcatcaaatattggatgacttacgtaaaaaaaccaaccctggctactctgctattggtcggttaaaaggtctagctgaatttcgcggtttagagatggcattaaaaaaagtgtatttcaataagtaaaagaaaaagtgcggtcataaaaaacattatttttatcgaccgcacttctaatttatttcatcaatcttctcattcgaatattgatcatctcgaccacaacagagaatcccattgcaaaatagatgtaacctttcgggatgtgaatatccaaactttctgcaattaaactaattccgactaaaaccaagaaagctaaagctagaattttcaacgttgggtgtgtatccacaaaatcgccgattggttttgccgcaaacatcatcacccccacggcaatcataatcgccaaaatcatcacaggaaggtggcttgccatacccaccgctgtaatgacagaatctaaagaaaatacaatatctagcacagcaatttgaattaatacgccaagataactcactttgtttttgctttcagattcatggtgttcttgatgatttatcgcctctttaatttcgccagaactttttataatcaggaataaaccaccgattaataaaatcaaatcacgcccagaaatttcttgattaaacacagtaaataacggtgcagtaagtttcattatccacgctagtgacattaaaagtaaaattcttgttagcattgccaaagcaagcccaagaatacgaccagactggcgttggcgttcaggtaaacgtccaactaggatgttaataaaawtaatattgtcgattcctaaaacgatctctaaagccgcaagtgtcacaagtgatatccacgcttcaggatctgcaatccattcaaacataatttttcctataattgagttaaataaatccgaaaatacagatcataatggctttatgacgaaaagcaatcgttatttatatttgagaaatgattgattagtcgtttttaagcgtttcaaaaatcctttcagcaagtttaggggaaatgcccggtacagaggctatttcatctaaggtcgcctttttcacaccttgtaaaccaccaagatatttcagtaaagcctgacgacgtttagctcccacaccttcaatggtttctaaaccactttgtgtaaaggctttttgacgttttttacggtgtccgcttattgcgtgattatggctttcatcacggatgtgttgaatcaaatgcaatgccaaactatcatcaggcaaatgaatttcgcggtcttgtttgctgatgatcagtacttcctgtcctgctcgacgatccacaccttttgccacgccaattaagtgcggtctatttttatcccattttacttgaagatgttggaatacattcagcgcacgatttaattgcccttttccaccatcaataaaaataatatcgggaattttatcttcttctaaatcacgctcataacgtttctgcaacacttgttccatcgcagcataatcatccccgccagtaatgccttcaatattaaaacgacgataatcagattttagtggaccttctttattaaaaacaacacaagatgctactgtttgatttcccatcgtgtggcttatatcgaaacattccatacgcttaattttaggaagatttaacagatcacacaacgcttgataacgctctgacattcgtgaagattgtttaagttgtacatttaaagccgctttagcattaacttgtgcgagctgtaagtatttacttttatcgccttttacgctttcttgaatcgtcacttttctgcccgcttgctcgctaagaagttgctcaagctccgatttttcagctaattgacgatccacaataatgctattcgggatacttcgtccttgatgaccttgtaaataaaattgccccacaaaagtttcggtaagttccgataaatccgtattggcggggacttttgggaaataactgcgattgcctagcacttttccttgacgaataaacatcacctgtacacaggctaacccgtgttggtaagcgatagacataatatccatatcatctaaacgttcattggatacaaattgtttttctataaccgaacgcacagcctgaatttgatcgcgataacgagcagcctgttcaaaatctaaatttctgcttgcctgctccattttaccgattaaataatctaacacctgttgatctttgccttgtaaaaataagcgagctaattcaacttgctgattatattcttcatcggaaacatatccctgtacacaaggtgcagaacaacgcccaatttgatactgcaaacaaggacgagagcggttggaataaacggaattttcacattggcgaacagggaaaagtttttgcaaaagcgataacgtttcacgcacggctcccgcgtgaggataaggcccaaaatattcacctgcaaattttttagaaccacgataagaagtaattctttggtggcgttctttggttaataaaataaatggataggatttatcatcacgcaataatacgttataacgaggctgataaagcttgataaaattatgctctagcagtaaagcttccgtttcagatgaagttagcgtggtgtcaatatgatgaattgacgccaccaacgcctctgtttttttactgctcagatttttacgaaaatagcttgaaagacgtttctttaaatcctttgctttcccaacataaataacctgatctttatcgtcatacatacgataaacaccaggttcgtgagagacatcagtgaggaattttttagcatcaaacattttaattcgccgctaaaattgcccgcactttttccaaatcttcggcggtatccacccccactgcaggcacttctttcgcaagttctacgtgaatacgttcgccgttatataacacacgaagctgctcaagtttttctagattttcaagttgagtcggtgcccattgcacatattgttttatgaaacccgcacgatatgcgtaaatgccaatatgacgtaagtaagcgtcagaaagctgtactttctgaacatcctgcaaattcataaactgatcacgatcataaggaataaccgaacgggaaaaatacagcacatagccatctttatctgttaatactttcactgcatttggattaaataattcctcagcatcgtgaatttttaccgcaaggcttgccatattgacattaaattttgctaaattatctgccacttgtcgcacgataacgggaggaatcaaaggctcatcgccttgaatattgacaatgatttcattgtcaggaatagctaatttttctacaacttctgctaaacgttctgtaccagaattatgattaaccgaagtcatacagacttcagcaccaaaacttttggcaacatcagccacattttcattatcggtggcaataatcactcggctcgccccagactgcagtgctttctcaaatacatgttgaatcattggcttacctttaatatcagcaagaggttttcctggcaaacgacttgatgcaaaacgagcggggataatcacggtaaatgacataatttattccttattctttaatatttcagctttatcggcaagcaatcaaaacaactggggattaatcctttcagccatttctgtattgctccacaagtttgtctattttggcccaaaagtgcggtaaattttcacgttgtttttcagcctcaataatctccgcatccacagggacataccaccaattatctttagcaaaagattggcattttacggcatctttttccgtcataaagagcggttgattttcagcaagtttttctaattgagacgcttcaaaatgttgatgatcttgaaatgcttgagtttgctttaactgaatccctaacttttctaacatagtaaaaaaacgctgtggattgccaatccctgcgatggcaacaccagattgaaattcatttaattggcgtttttcattggtttttaaattaatcgcgaaatgaggcacaagacgcataactgcatctgaatactgattttttccaccattagtgatcacaaaatcgacagattttaatcgacttggtaattcacgcaatggacctgctggcaatacaaaaccatttcccaatgcgcgctcagcgtccattacgacaatttctaaatcacgttgtaattgataatgctgcaaaccatcatcagaaataataatatcgcactctgcttggcttaagagtaattcaatcgcttgctggcgattcggggaaatcacaactggcgcattagtacgtttagcgatcaatacaggctcatcgccaccttcaattggatttgtatttttagtgacgaataacggataagttttagatttactgccgtaaccacgagaaatcacacctacacgcagacctcgtttttttaattcttccataagccaaacaaccacaggcgttttgccatttccacccacagacaaatttcccacaattatcactggttttggtgcgcgataagaagacttcagccccaaagagaataaggcgcgacgaagttggctaatcaaccaaaacaataaagaaaaaggcgataagagccaaataagtttggagttggaataccagaagggcatagaaaatcctttctaataagtgcggataaaataacgcgagtttttcaactcgcgttttcgataatcaataaattagccagtaaactgcatactatgcaactgtttataggcaccattttgttcaagcaatgttttatggttgccacgctcacgaatttctccgtgatcaatcacaagaatttcatccgcgttttcaatagtagataatctatgggcaatcacaacaaccgtgcgatctttctttaattcctctaatgcagattggattgctcgttctgattccgtatctagtgcagatgtagcttcatctaaaattaatactggcgaattacgcaataaagcacgagcaatcgctaaacgctgacgttgcccacctgataggctagtgccattttcgccaattaccgtatcaaaaacttgcggtaatttttcgataaactctaaagcataagccgcttttgctgcagcgataatttcttcgcgagaatacttatcttgtgctgcataagcaatattattcgcaatagtatcgttaaataaatggacttgttgagaaaccacagcgcagttttcacgtaaattagataaacgataatcttggatatttacgccatccagtaaaatttcgccttgctcaatatcgtaaaaacgtgtcactaaattagcaatggttgatttgcccgatccagaacgtcccactagagctacggtttttccagctggaacgctaaaagaaatattatttaatgcaagttcatcttttccttgatatgcaaaactcacatttttaaattctaactcgcctttcgcaggttctgctttataagccccgtcatctttttctggctctaaatctaaaatggcaaatagcgtttgacatgctgccattccactttgaaattgtgcattcaccgcagttaatgattttaacggacgcatcatagctaacattgaagaaaataccactgtaaatgagcctgcactcaaattatcttctgcaatcaatggagtggtagctaaatagagcaccgtagctaatgcgagagatgcaataacttgcaccacaggatcagaaatggaatttgctgtcaccattttcatgctttttcgacgcatatcattactaacatgattaaaatgcacttcttccacatgttgccctccgaaagaaagcacaactttatgaccttttaacatctgttctgtagcagacgtaagttcacccattgaatcttgtaagttcttacttaatctacgaaaaatttttgataccaaacgaattaaaacagcaatgattggacctataataaaaagcacaattgttaattcccaactggtataaaacatcactgcgaatagcgaaataatatatgctccttctcgcacaattgtaatcaaagatcctgaagaagaacttgcaatcatttgggaatcataagtaatccgagaaagtaaacgccctgttgaattttgatcaaagaaactcactggcataaacattaaatgtttaaacaagcggcgacgcattgtcatgacaactttgcctgatacccacgccaagcaataattagaaataaagttggtaatgccgcgtaaaataatcatcccaacgacgacaaaagccatcattttcaaaaatgaatggtttgccttaccaaaaccatcgtccaacaacggttttaacaaataaatcaagcctgagtcagctaatgcattaaaaactaacgcgacgccagaaacaataagccccgctttaaaaggtttaatcattggccacaaacgcttaaacgtttgtaaggttgaaaaatcattttcttgtaatttttgctcttgcataatcgctatctaatagtaaaaattgcacgcattgtaccttttattcctttgataatccaattacacgcgcataccaaggggaaaattttgtgcgagcttgctggatttctaatcggtcttgaaaaaaatttacccgcacttgccccgaaacagcggtattttctaccgcacttttatagcgatgaagcctttccataaccgaataatgagggaatttccacggattccaacgcccactagaaataatcgctacatctggtctaacctgagaaagcaagtattcacttgtcgatgttttactcccatgatgccccacttgcaacacatcgattttgcctaaagtgcgggcaaaaatttgctcattttttgcttcagcatcgccagttagcaaaacgctattctttccatcatcgactaaaatcacacaagaatgggaattatcagctcgtgtcacaacgttgtgaggagaaagtatttgaaaatgcaacccttgccaatgccaatcacgcccagcagtacaaaaagtgcggtaattttccccatagtttttccgtgaaggggtaatcaattccacattgggatacgcctttaaaattgtcgaagcaccacctgcgtgatcgttatcgtcgtggcttaaaatcaatttttccaaaacaatcccttctctttgtaaataaggcaaaatttccaactcagccatacttccacctcgccaagaagaacccgtatcataaagaatccctttaccatttttcacaatcaacgtagctaacccctgccccacatctaaagtatctacctgccaagttggcttgctcaattgtttaaacaacaaaatcgtaaaacacagtaagataatgccgaaagaacatcgcaaaacgttgattcgttcattttttagcaaaggcttactgagatttaatgtaaaaaattttgctcgttttatttgccagtttgatgatgaaatctcgggttctcggtaaatattccaaataattaacataaaaattcctgcacaaagtgcggttaaacccaatgctaaattaaatgaaaccgtgagccaattcccttgaaaaacagaaattaacccagtaattccttcggctagcttgtttgctagttgccaagaaaacattgtgccgttagtaaaaacggcaaataaaattaatggcacaagcaaaaaactataaattggaaccgccataaaattggctaaaaatccactcaacgataagccattaaatagaaaaagttgcaaaggtgtaaaaaagagcaataacccaaattgcaaatgaaataaactaaaaatccaccgcacttttggagaaaaagggcgatttttccattgaaaaagtgaaaaaggcacataacgataccagaggagcaaacacccaaccgctccacaagaaagccaaaaactgaccgaaagcggcattaatggatcgcagaaaagcaagaatccgacaaccaacgtaaaaaactgaatgggcgaataatgtcgcctcattatttgaataaataaaacgaaaacaagtgctgaaatggcacgaaaagttggcacactaaaaccagccaaatacgcataaattaaagcaaataaaacaccaaaaactaaaggaaaataaggatgaataaaacgcgtaggaaagaacacttgcacaacacgcgccaagcaaaatccaattcccatagccaacccaatatgtaagccagaaatagcaataagatgtgcggtattggtttgttggtaaattgaccaagtggttttatctaaccaagcccgttcgccaaaagctaaggcaatcaataaaccttgtagagataatccttccgtttgcttctttacttgttgcaatttttctgcacgcaatgatgaaacatccgcaattttcaccgcactttttaccgttccaacagccgtaattccttttgaaaaataccattgttgccgatcaaacccaccgaaatttaatcgtgcagaaagggaacgtaaagaaatttcagcttgccaaatttccgataattgaggcacctctttcgctttccaatttaagaaaattcgttgttcttgcaaattattctccaatgttgctgtggcgataagcgtttgataatcctgttggtgcaaaatttcttgaatcttaaaagttaccacttgcttttgagcggtaatattttgagcttgttgtgataaactcaaagccgaataatgaaaatagccaagagaggcaacaaaaaaagcaaggctaactaagaaatttctacgcaagaaaataaaaagaaaaatcaaaacaagcgcaataacgagagcaacttgccaaggcaatagcaacggttgcggtagaaataacaacgttaaatccgcgacaattaacaagacaactaaagttattaagtttaatttcatttttataaaagattaattccagcctctctaagcctaggctagttttatttaaatatgcaaacggttgcttcaaattttgcgatccatatcgtaaaaataaatttttcaggaaaatttacttgctaaaacaaacaacttctgatatttataccgcccgcaaaaattgggttcctaaaatagcagtcaggaacaaactaaaataacaagacaggaagtcgtgaaatccacgcttaattctgtatgtattaggagtgagagatgtcaagagcatcattgagcttgctagatttagcaggcgttaagccttatcaaatgaaaaaagatgaagaatatatgantgangagcaaattcttcatttcagaaaaattcttaatgcttggcacgagcaaatcgtggaagaagcttctcgcaccgttgcacatatgcaggatgaagtaaccaatttccccgatcctgcagaccgagcaactcaagaagaggaatttagtctagaattacgtaatcgagatcgcgaacgtaaactaatgaaaaaaatcgaagcaaccttgaagaaacttgataccgatgattttggttactgcgattgttgtggtgaagaaatcggcattcgccgtttagaagcgcgcccaacagcagatctttgcattgattgcaaaactttagctgaaatccgcgaaaaacaagtcgctggttaattcattctattgaaaaatacaaaagtgcggttaaaattaaccgcacttttttgcatttaaaaatgcaggaaaatccacttgcctttttctttacaagaaaagagccaagtcatttatttccaacaacaaaacggagtaaattattcttacttatatcaaaaatttgtttggcaagaagacaaaaaaatcaaaagaggttgccaaaacaagtgctcattctaaacgagttgagcgttctaatagccaaatgccaaaagcgcgagcaaaaaaatcagaacaaacacgtcgctatgataaaaatgtgattaaagcggctcaatttgatatttctccgcgtgattttagccgtaatgctctcaatgtagtggaaaaactgcaacgtcaaggttttgaggcttatatcgtcggtggatgtatccgcgatttattgctcggtaaaaaaccaaaagatttcgatgttgcaacaaacgcccgccctgagcaaatccaaaacattttccaacgccaatgccgtttagtgggtcgccgtttccgcttagcacatattatgtttggtcgagatattattgaagtcgccactttccgtgctaatcacagtgatgctcgcaatgaaaatcaagcgaaacagagcaatgaaggcatgttactgcgcgataatgtttacggtacgatcgaacaagatgcagcacgccgtgattttacggtcaatgcactgtattacaatccgcaagataatacgttacgagattatttcgagggcattaaagatctcaaagcaggcaagctacgcttaattggcgatcctgttacacgttatcaagaagatcctgtgcgcatgctacgctcaattcgttttatggcaaaacttgatatgttccttgaaaaaccgagcgaacaaccaattcgtgracttgcgcctttattaaaaaatattccgccagctcgcttatttgacgaaagcttaaaattattgcaggcgggacaaggggtaaaaactatcggttattacgccaatatggtttatttgaacaacttttccctgcattaagcgcatattttacagagaaagaagatagctttgcggaacgtatgatcgtcactgcacttacttctacggatgaacgtgttgcggataaacttcgtattaatcctgcattcttatttgcagcatttttctggtatccattgcgcgaaaaagtggaaattttaaaaaatgaaggtggtttaaataatcatgatgcttatgctttagcaggcaatgaagttttagacttattctgccgagctttagctgcaccacgtcgtcatactgcggtcattcgtgacatttggttcttacaactgcaattattaaaacgtactggatcagcaccaatgcgtaccatggaacatccaaaattccgtgcaggctttgatttattggctatgcgagcagaaattgaaggtggcgaaaccattgaattagccaaatggtggcacgaatatcaattcagcaatggtgaacagcgtgaacagttgatacaagagcaacaacgcttacatcctaaaccaaagaaaaaatactaccgtccacgccgtcgtaaaacaacgtgctcagcagaataagggaaaagatgattacggcatatattgctctaggtagcaatttaaacacaccagtagaacaattacatgctgcgcttaaagcgataagtcagttatcaaacactcatttggtaacaacgagctctttttataaaagcaaaccgctcggcccacaagatcaacccgattatgtgaatgccgttgcaaaaattgaaaccgaacttagtccgctcaagctattagatgaattacagcgtattgaaaacgagcaaggtcgagtgcgtttacgtcgctggggcgaacgcacgttagatttagatattttgctctacggcaatgaaattattcaaaacgaacgcttaacaattccccattatgatatgcataaccgtgagtttgtcattgtgccgttgtttgaaatcgcatcggatttagttttaccaaatagtcaaatcataacagagctggtcaagcaatttgctgaccacaaaatgataaaattaaatccctagaaatttcaccgcacttttatgaacctcaaaagtgcggtagaatcagcccacatttttcttcattcatgacccgttatggaaagtttgactcaatatatccctgatgaattttctatgctccgcttcggcaaaaaatttgccgaaattcttttaaaattgcatacagaaaaagcaattatggtttatcttaacggtgatcttggggcaggaaaaacaacgctaacgcgcggaatgttgcaaggtatcggtcatcaaggtaatgtaaaaagcccaacttatacgctggttgaagaatacaatattgcaggcaaaatgatttatcattttgatttatatcgtttagcagatcctgaagagctcgaatttatgggcattagagattattttaatacggatagcatctgcttaattgaatggtctgaaaaaggtcaaggcatattgccagaagcggatattttagtgaatattgattattacgatgatgcacgaaatattgaattaatcgcacaaacaaatttgggtaaaaatattataagcgcattttctaattaacttatttatgaaaactaaaattttatttttcctttttttctcaacgtttagtttctctatttttgcagcacctattacgattgcgattgacccaggtcatgggggaaaagatcctggtgcaatcagccgaaacttaggcatttatgaaaaaaatgttaccctttcaattgcaaaagaattaaaagccttattagataaagatccacattttcgcggtgtattaacgcgtaaaagtgattattatatttccgtgccagaacgttcagaaatcgcacgtaaatttaaagcgaattatcttatttccattcatgccgattcatctaaatcacctgatcgtcgcggggcttctgtttgggtattgtcaaaccgtcgagccaatgatgaaatgggtcaatggttagaagacgatgaaaaacgctcggaattacttggtggagcgggaaaggtgctttcacacaataatgacaaatatcttgaccagactgtacttgatctgcaattcggacatagccaacgtacaggctatgtgttaggcgaacatattttgcaccattttgctaaagtaacaacattaagtcgcagtacgccacaacatgcaagtctgggtgttctacgttcgccagatattccttctgtgttggtagaaactggatttctttccaattcagaagaagaaaaaaaacttaattcccaaacttatcgtcgccgcattgcttatatgatttatgaaggcttagttgcattccatagcggtaaaaccaacactttagttaaagacaatttagtgcaaaacatcaaacaaaacgatataaaaaaatcagggaaaaataaccgcacttcagaacaaaatataaatgaagataatattaaagacagtggcattcgccatattgtaaaaaaaggagaaagtttaggtagcttatcaaataaatatcacgtaaaagtctctgatattattaaattaaatcaattaaagagaaaaacactttggctaaatgaaagtattaaaatccctgataatgtcgagataaaaaataaatcattaacaattaaagaaaatgattttcataaaaaacaaaatagcttagtaaataataccaataaagatttaaaaaaagagaaaaatacacaaactaataatcaaaaaaatataattccgctctatcataaagtaacaaaaaaccaaacactttatgctatttcgagggaatataacattccagtaaatatactattgagcctaaatccacatttaaaaaatggcaaagttattacaggacaaaaaataaaattaagagaaaaataaatgcctattaaaattctttccccacaacttgctaaccaaattgctgctggagaagtggtagaacgccctgcatcagtggtaaaagaattagtggaaaatagccttgatgcaggtgcaaataaaatccaaattgatatcgaaaatggtggggcaaatttaatccgcattcgtgacaatggctgtggtattccaaaagaagaattaagcctcgctttggcacgacatgccacgagtaaaatagccgatcttgatgatctcgaagcgattttaagtttaggttttcgtggcgaggcattagctagtatcagttccgtatcacgcctaacccttacttctcgtaccgaagaacaaactgaagcgtggcaagtttatgcgcaaggtcgtgatatggaaaccacaatcaaacccgcatcacatcctgtcggcacaacagttgaagtcgccaatctttttttcaacacaccagcccgccgaaaatttttgcgcacagataaaacagaattttcccatattgatgaagtcattcgtcgtattgctttaacgaaattcaacacagcatttacattaacgcataatggaaaaattatccgtcaataccgtcctgccgaagcaatcaatcaacaactaaaacgtgtcgccgctatttgtggggatgattttgtcaaaaatgccttacgaattgagtggaaacacgatgatttacatttatcaggttgggtggcgacaccaaattttagccgaactcaaaatgatttaagttattgctatattaatggccgaatggttcgagataaggtaatcagccatgctattcgacaagcctatgcacaatatttaccaaccgatgcttatcctgcgtttgtgttgtttattgatttaaacccgcacgatgtagatgtcaatgttcatccaaccaaacatgaagtacgctttcatcaacaacgcctcattcatgattttatttacgaaggcataagtcatgcgctaaacaatcaagaacagattaattggcatacagaccaaagtgcggtagaaaatcacgaagaaaatacggtgcgtgagccccaaccgaattacagcattcgtcctaatcgtgcaactgcggggcaaaatagctttgcgccacaatatcatgaaaaaccacagcaaaatcaaccgcacttttctaacacaccaatgtttccaaatcatgtaagtactggttatcgagattaccgttctgatgcaccgagtaaaactgagcaacgtttatatgctgaattgttacgcacgttaccgcctacagcgcaaaaggatatatcggatacagcacaacaaaatatttcagatacagctaaaatcatctcaactgaaataattgagtgttcatcacatctacgagccctttcacttattgaaaatcgtgcgttgttattacaacagaaccaagatttctttttgctttcattggaaaaattacaacgcttgcaatggcaactagcgttaaaacaaatacagattgaacaacaggctttattgattccaatcgtgttccgattaaccgaatcacaatttcaagcatggcaacaatattcagatgacttcaaaaaaattggctttgaatttatcgaaaatcaagcacaattacgcttaaccttaaataaagtgccaagtgcattacgcacacaaaatctacaaaaatgcgtgatggcaatgctgactagagatgaaaattcatcatcatttttaaccgcactttgcgcacaattagaatgcaaaacctttaacgctttagcggatgcactcaatttattgagcgagacggaacgtttactcacgcaaacaaatcgcacagcattcacccaattactcaaacctgttaattggcagcctttattagacgaaatttaaattcttcatgaaaccaaccgcaatttttttaatgggcccaacagcctcaggtaaaacagatttagccattcaactacgaagccaacttccagtcgaagtgattagtgtggattcagctcttatttataagggaatggatattggcacagcgaaaccatcaaaagaagaacttgcccttgcgcctcaccgtttaattgatattttagatccatcagaaagctattccgcaatgaatttccgcgatgatgcgctacgcgaaatggcggatattaccgcacaaggcaaaattccgttactagtgggcggcacgatgttgtattacaaagccttaatcgaagggctttcgcccttgccttctgctgatgaaaatattcgcgccgagcttgaacaaaaagcagctcaacaaggttgggcagcattgcatacagaactcgccaaaatcgatcccatttctgccgcccgaattaatcccagtgattctcaacgaatcaatcgcgctttagaagttttttacatcacaggaaaatcactcacagagctgactgaagaaaaaggcgaagccttgccttatgattttgtgcaatttgcaattgcgccgcaagatcgccatgttttgcatgaacgcatcgaacaacgctttcataaaatgattgaactaggctttcaagcagaagtggaaaaactttatgcgcgtggcgatttaaatattaatctgccgtcaattcgctgtgtaggctatcgtcaaatgtgggaatatttgcaaggtgattacgcttacgaggaaatgattttccgtggtatttgcgctacgcgccaacttgcaaaacgccagcttacttggctgcgtggttggaaaacaccaatacaatggctagatagtttacaacctcaacaagcgaaagaaactgtattacgtcacttagattcttatcaaaaaggttagaaaaaatgaccgcactttctgccctcatcgaacaaaaattacaatctcttggcacaatcctgtgccaatcttttccagaactttccccagaaaaaattcacgaagccattcaacaaaattcaaatcatccagaactgcctgtttatcaattaggctatgccatagcaatgtctgactttgtggaaaaagtcttgcaaaaatacccgcacttagtgaaacaatggtgggaaaaatccccctgttttgcagattgcactgcctatattgaacgtttgaataaagagttagccaatgtacatgacgaaactgctctctatcaaacattacgccaattccgtaacattgaaatggcaaaattaagtttttgtcaaagtttgaatcttgcgacagttgaggaaatttttgttcagctttcacaacttgcagagagtttaattatcgctgcccgcgattggctttatcatcaagcctgtgcggagataggcacaccaatggatgaacaaggcaatccgcagcagctttatattctaggaatggggaaattaggcggctttgaactaaatttttcctcagatattgatttaattttcacttatccatcacaaggggaaacgtccgttgagaatacgaatgctcgacgttctgtggataatggaaaattttttacacgtttagggcaacgccttatttctgccttagatgaatttacctctgatggttttgtatatcgaaccgatatgcgcttgcgcccatttggcgatagtggcgtgcttgttctcagcttttcagcaatggaacaatattatcaagatcaaggtcgagattgggaacgctatgcaatgattaaaggacgagtattgggcgcacaaacaaaggatcccaacgtttcaaaattgaaaaaaatgttacgcccttttgtctatcgccgttacattgactttagtgtgattcaatctttacgtgaaatgaaaggcaaaattgagcgagaagtacgccgtcgtggtttgaaagataatattaaactaggtgctggtggtattcgtgaagtcgaatttatcgtacaagtttttcaactcattcgaggcgggcgagaaatcaatctgcaacaacattcactcttaaagatcttgcctgaaattaccaaactaagattaattaccgaacaacaattccacgatttacgtgaaagttatatttttttacgccgcgtagaaaacattctacaagccattaacgatcaacaaacgcaaacactaccaaccgatgaaatagatcaaattcgtttagtcgaggcatgtaaaactttcacctgtttaaatgaaaataatcaaaccattgaaaaacattatccaatagaaaattgggacgatttttaccgcactttacaacaaaaacaagaaaaagtgcgggcagtatttactcaattaatcggtgatgaacaagatgagtcttcacaaactgatagccaatggcaagattttttagaagcagattttgaggatattgaacaaacattattagagagtagtgtatcggaaaataatattgatgaagttttagaaaagcttgctcaattcaaagacggcctaaatcacagagtgattggttcgcgtgggcgtgatgttttgagtcatttgatgccaacagtacttgcactcatttttgaacaagaaaattaccgcactttgcttccgcggattctgaacattattgaaaaaatttcgagtcgcacgacttatttagaattattattggaaaatcctcgcgcacttcagcaagttattgaactttgtgcgcagtctcaacttatttcagaacaattggcgcactatcctattttattagatgaattgcttaatacggaagcactacgtcatcctttgccatttacccaatatcctgcagagttacaccaatatttgcttcgtttaccccctgatgatgaagaacagcttatcgatgctttacgtcaatttaaacaagcaaccctattaaaagtggcagcggcagatattttaggtgcattgccagtaatgaaagtaagcgatcatttaacctatcttgctgaagccattattgaagtggttgtgaatctagcttggaaacaagtttcctctagatttggtgtacctgaacatttacaaaataacgaaaaaggatttttagttattggttatggaaaactaggtggtattgaactcggttataaatccgatttagacctcgtatttttgtacgatgccgtagaaagtcaaacaacaggtggcaaaaaagtgattgatagcaatcaattttacctacgcttggcacaaaagattgtgagtattttcagcataaatacttctgctggcgtactttatgaggcagatatgcgcctgcgcccttctggcgatgctggcttaattggctgctctctttctgcattttctcattatcaattgaatgacgcttggacatgggaaaaacaagcacttgtgcgcgctcgtccagtatttggcgaatcatctcttaaagctaaatttgagcatatccgccaacaagtgctttctgcatcacgagatattgaacaattaaaacaagatgttgttgagatgcggaaaaaaatgtttgcccatttatctcactcaaaacacagtgaatttaaccttaaaacagatcgcggtggcattacagatatagaatttattgctcaatatttaatgcttgccaatgccccgaaaaaaccacaactaacaaaatggtcagacaatgtacgtattttcgatgatatggcagaggctaaaattattagccaaacagactgcgacacattaaaacaatgttatgtcgatttacgcaataccattcatcatttaaatttgttgggtaaatcttccgttgtggaagacagtgaatttgttaaagagcggtcatttattcaagcattttgggataggttatttgtatcctaaaatatggcttgtggacgtttcaaaaatagccttcatcacaaatcttcttgaaacctcccaaaaactaaatattcaatcctatttttaatgaaccaaatctaacatttcctgtgcattggctagagctaattctgtaatttcacttccgcccaagagtcttgccaacgcaggtacacgttcagcttgtgaaagtgcggtcatttttgtttcagttttattatcaacagtaaatttttccacattaaactgatgatggccatgacaagcaacctgtggcaggtgggttacgcataatacttgacaacgctcacttaattgacgtaaaagttttccgacaacacttgctgtttttccgctaatgcccacgtccacttcatcgaaaattaaggttggaatagccgattgatcagaagttaaaacttgaatggctaaagaaatacgagaaagctcaccaccagaggcaattttagctaatggctgcggttgttgtcctaaattactacgcaaagtgaaaatcacattatccgcaccatttgcactcactttatctaaatccgtattcaactctacataaaattcagcgttttccattgcaagttgttttatcgactgtgtgacattttgcgctaagcgggttgcagattgctgacgacttgctgttaatgctgtagccgttgcttgcatttgttcaaatgctcgtttttcttgctcaatcaacatctcttcactttcagaaaaatctaaaagtgcggttaattctgcttttaattttttgtgctgttctacaagatcttcaggtttaacttgatgtttacgagcaagttgtaaagtctgactaattctttgttcgatttcctgtaaaagctgaggatcttgctcgatattacttgataaattttgcacttcactggttgcttcttgcacttgaatcaacgcatcattcaacatattttgcacttcagcatattgcggatcaagttcagctaattcatcaatatattgtgtcgcacgataaagcaaactatcgatatttacggtgtcattttcacttaaaatttgtagggctgattgggaaagttgagttagctgttcgctgctagataaacgacgttgttcatcttctaattccaaatattcatttggtcgaaggttaaattcatctaactcatccacttgatactgtaaaagttgtttacgtgcttcattttccgccactttttgttgaaaggttttaacttgattttgaagatttttccatgtctgataatcttcacgcattttcacaagtaattcaggatgagcggcaaaattatcaactaactgaagctgatagtcattttttaacaataattgagaagcgtgttgcccattaatatgaacgagatattgagcaatttcttttaattgagaagcggatactggtgtactattaataaaagccttagaacgtccgtctgcattaattatgcgacgtaaaatacattcagttggattatctggatcctgtaattcttgctcactcaaccagtgataagcaggattttgcgattctagttggaaagttgcacaaatttccgcacgctcttgcccttcacgcaccattgaggtttctactctttgtccgaaacataaacctaaagcatcaatggcgatagattttccagcaccagtttcccctgttataacagacattcctttcgccaattcaatatcaagctgacggacaatcgcaaaattattgatagtaagttgagtaagcatagcaaaatcctttaactgtatatttaatatgatataactgacttaatttacagtaaaggattttttacagtattttgtcaaatctatttcaatcgaaaatttttaccataatcaaaatgattttaaccaacctaatttgctacttaacacattgtaataattataattttcagatgaagcaatcggagtttatgctcgcttttttgaatatgcaccacatcatctggggtaaaaggtaaggtaatttgactatcacagcccacttctaattgagaggtattatgttcagcaaaacgaatcgatattttactatccccatcaacaacaagagggcgagaagttaatgtatgtggaaacattggcactaatgcaatggcattaaggtttggtgtcaaaataggtccaccagcggaaagagaataagccgtagaacctgttggagtagaaacaattaatccatcagaacgttgagaaaatgcaaacttatcattgatatatacgtgaaaatcaatcatatgtgcaattttggcgggatgaataaccgcttcatttaccgcattgctggttgatacgatttcacttgctcgttcgatttttgcttccaataaaaaacgttcttccacaaaaaattcgccacgttctaaacaagcttcaagctgggaataggcatttttcgggtcaatatccgttaaaaatcccaaattaccacgattaataccaatcaatggaatatcatattttgctaatacgcgagcgcgccctagcatattgccgtctccaccaatcacaatggctaattgggctcggtggcctatttcttctaacgtagcaagatgttcaaaaggtaactcaagtgttatggcgacttctttttccaccaacacttgataaccacgttccattaaccaatgaaataagtttttgtgcatttgtaagttaatatcattgcgaggcttacctacaagagcaatggttttaaaggaacgatataaatgattcataaaatgaccgcacttgaatttaacattttcgtcattatatcgttttttgctacactatgcccaattacgattaatcaattttgttttacggagaaaaaaatgtcagaacaagaacaaaaagttgaaatcccagaagtagaaaagcaagaagaagtcgttgtggaagaaacacaacaagcagagcattctcaagaatttgatcctttagaagaagcaattgctcgcgtgcaagagcttgaagagcagctaaaaactcaaatagaagaagcggcaaacaaagaacaggatattttacttcgctctcgtgctgaaattgaaaatcttcgtcgtcgtactgaacaagacgtagaaaaagcacataaattcgccttggaaaaattttcaaaagacattttgaatactatcgataacctagagcgtgcccttgccactccagcaaataaagaagatgaaagcgtaaaagccttatttgacggtgtagaactaaccttaaaagaattagtttcaaccgttgggcgttttggcgtggaagctgtgggagttgtcggtgaagcatttaatcctgatttacatcaagccatttcaatgcaaccagctgaaggctttgaaaccaatcaaattagcgtcgtattgcaaaaaggctacaccttaaatggtcgagtcattcgcccagcgatggtaatggtggcagcttaatttacattttgtctaaagagcggtcggtttttcgaccgttttttctttttcctgaataactacataaactttacggataatttccctaaaatcttcgctcgttgtagcccaatctagaagatcaacgcgccacggtaaatctgattcagaaaaagcttcctttaatctgtcacgagctaaaaaatctaaaggttcctcagagataatcgcaaggtcaagatcggaatatttttttgcttttccctttacacgagaaccgaaagcccacacggtataatcaggtactaattgttgtaaaatagttttcacaatcgccaattcttcagattttatatcaagctgtgcaaaactagtcatattgatttctctgacgtaattgttccaataggaaactactttctattaaaaaatcatcaatttgtgcataaacagccatggctttttcctgatcataagtatgtgatgtaatattacgcatatcacgataagcaacccattttgacatatctccaatcaaaccaaatctcaatgcttctcgcaaaatatccttaaatccataagccccaatgtcatcggtattaattgcatcttgttgaagttggcgtttcatcatttttaaacttaactcataaacaaattcaaatttctgaattgcacctgcaattaaggtatcttgtacaatagagggttgcatatcaaaccaatttctgtctgaaatttgtactacggtttgctctaacgaataaaatgcagcatctaatacatttaaatttagcttatcagtcatcatttttacctctgttaaatactcatctattttaccatagactattttttctcaaaacctataaccccaaaagtaaacattgtgatattgatcacaaaatcaaaaatatttgagaaaagctctcaacaacttaatttgatatttttctaataaaatcaatctttaacaaaattatcttacgacaaaaaggtctaaaacactacatattgtgtgttgattatctttttagatctatatatagtgcaatccgcatttcaaaaacactatatattggagctatatcatgagtaactttggggtcatcaagcgcgatggttctcgtgcggagtttgagattcaacgtatcattaatgccattaaaaaagccgcaagtncggtcaatatttccgatgaattttattgccaccaaattgggcaagaagtagggaatgaaattttcacccgtcatcaaggcgagattgatattaatcagattcaaaaaatcgttgaagataaattgatggcaagtcgttatcctgaggttgctcgtgcgtatatcgaatatcgtcatgatcgtgatttagcacgagaaaaacgtagccagctaacaaaagaaattgaaggtttgattgaacaaagcaacgtagaattacttaatgaaaacgccaataaagacgcgaaagtgattccaacgcaacgagatttgcttgctggaattgtggcaaaacattatgccaagcacaatattcttccacgcgatgtggtagaggctcacgaaaaaggtgaaattcattatcacgatttagattacgcgccgttctttccaatgtttaactgtatgttagttgatttagaagggatgctttctcgtggtttcaaaatgggcaatgcggaaatcgaaccccctaaatctatcggcaccgcaacggcagtgacagcacaaattatcgcccaagttgccagccatatttacggtggcacaaccattaatcgtattgatgaagtgctttccccttatgtgcaaatcagttacgaaaaacacctcaaacatgcccaagaatggaacgtgcctgatgttgaaggttatgccaaagcattgattgaaaaagaatgtttcgatgccttccaatccttagaatatgaagttaatacactacatacttcaaatgggcaaacaccatttgtgacctttggttttggtttaggtacaagctggcaatcccgcttaattcagcaagctattttaaaaaatcggattcgtggacttggaaaaaatcataaaacaccagtatttccaaaacttgttttcaccatcaaaaaaggtttgaaccaaaataaaggcgatccgaattacgatatcaaacaactcgcattagaatgcgcatcaaaacgtatgtatccagatattctcaattacgatcaggttgtcaaagtcacgggctcttttaaagccccaatgggatgccgtagctttttaggtgcatacgaagaaaaaggccacgaaattcacgatgggcgtaataatcttggcgtggtgagtttgaatttaccgcgtattgcgttggagtccaaaaacgaagaagatttctaccgcactttagatgaacgtttggctattgcgaaaaaagcattaatgacgcgcattgcccgccttgagaataccaaagctcgcgtcgctcctattctttatatggaaggtgcttgcggagtgcggttaaaagcggatgaaaatgtggcacaaattttcaaaaatggacgtgcctctatttcacttggctatatcggtattcacgaaaccattaatgcactatataacaaaggacatatttttgatgatgaacaattacgcgaaaaaggcattgcgattgttcgccaccttagcgaggcagtgaaacgctggcaaaaagaaacaggttatgccttcagcctttactccacgccaagcgaaaacttatgcgaccgcttctgccgtctagataccaaaaaatttggcgtaattgaaggcgtcacggataaaggctactacacgaacagttaccacttagatgtagaaaagaaagtgaatccttacgataaactagatttcgaaatgacatatcccccactcgccagcggcggttttatttgctacggcgaatatcccaatattcaacacaacttaaaagcattggaagatgtgtgggattatagctacgatcgcgtaccttactacggcacaaacacaccgattgacgaatgttatgaatgtggtttcaccggcgaatttgaatgtaccagcaaaggttttgtctgcccgaaatgtggcaatcacgacagcacaaaagtgtctgtcactcgccgcgtctgtggctatctaggcagtcctgatgcccgcccatttaatgcgggaaaacaggaagaagtgaagagaagagttaaacacctttgattaacacgatagcaaaagcacgcattttttaatgcgtgctttttgtttccaactttggcattcctaaaaatctccgctaaaataaccgcactttttcttatcttctaggaaagcaatatgtcagatattctcaataaccttattcatcttcttaaacttgaaaaaattgatgatttaatctttcgtggagaaagccaagatttaggttttcgtcaagtatttggtgggcaagttgtggctcaagcattatcagcggcaatgcaggtggcgccagaagatcgtattttacattcttgtcatgcctattttcttgctccgggagatagccaatatccgattatttacgatgtagaaaccttgcgtgaagggcgtaacttttctgcattatgcgtaaaagccattcaacataaaaataccatttgtcatgtaaccgcttctttccaagtgcctgaaaaaggttttgaacatcaaaatacaatgccaaatgttggtgcgcctgaagactttacggatgaaaatgtgatgctacaaaaagtagctcaaaccttgccagaaccactcaatgaaaaatttgcagcagagcgtccatttgaggtgagaacaaaatatttgaataacccatttaacgggacaaaattgccagccgagcaatattcttggtttaaaaccaatggtgaaacgccgcttgatataaaaattcagcaatgtttattagcttatttttccgattttcactgtattttgaccgcacttcatccgcacgaaaaaggctttttacaaaaaggaatgaaagtggcaaccattgatcacagtatttggttccatcgtccgtttgatttaaatcactggcatttgcacgcaattgaaagcaataatgcctttggaggtcgtggtttggcccaagggcagattttctcgcaagatggtcaattaatcgcaacaacacaacaagaaggcttgatccgttttagcgaataagagagaaaaaatgaccgcacttattacacaattttggcaacaagttgaaactgcgctgaaaacagcaaatccacaagaaaaatgtcgtttagtcaatgatctctacgataatcttctgccacaaattcagttgattaaattagaagattttcccgaaatcgtgccgcaagataatattgccgcttttcctgaaaaaccgctcttagttgcaccgaaagatgtgccaaaacgttcttttgccacagaagaaggctatgctgccacattacacgctatcgcacatattgagtttaatgccattaatttaggcttagatgcggcttggcgattcgggcgtaatgcacaagaagaacttggcgaaggtttagcttttgtgaaagattggctgcgtgtcgctcgtgaagaaagcacgcatttttccttagtcaatgaacatttgaaaacattgggttatcaatatggtgattttgaagctcatgctggattatgggaaatggcgcaagccactgctcacgatatttgggaacgaatggcgttagttcctcgtgtattagaagcaagaggcctcgatgcaacacctgttctgcaagagaaaatcgcacaacgtaaagattttgccgcagtgaacattttggatattattttgcgcgatgaaattggccatgtgtatatcggcaatcattggtatcacgccctttctaaaaaacggggtttagatgcgatgaaatgttttacagagctgttacacaaatatcgtattgtaatttttaaaggtgtcattaataccgatgctcgcattcaagcaggtttcactcagcatgagttggattggatttatgaagtggaacaaacattaaaatcctatattaagaaatgatgaaaaaataaagagactaagttcgattgaataccgaacttagtccttttaatgaaagtgatttaacgtttgaatttattgcttacgccaagttgtcccattcggcccatcttctaatacgatgcccatagctgtcaattcattacgtgctgaatctgcggcagaccaatctttagcagtgcgggcttcgttgcgttgtttgatgagtgcctcaatttttgccacttcatcatcgttagaacctgcttgtaagaatttctctggttcttgttgaagtaatcctaaaatcgcccccaattcacgcaaacgtgcagcaagtccattagctttctcaacatcttctgtttttaacttattaatttcacgtgccatttcgaataaaacagaaagtgcatttggcgtattaaaatcatcatccattgcttcacggaaagttgcaacaaaattttctccgccaaaagcaaccgcactttgatctgttccgcgtaaagccgtgtataaacgttccaacgcaccttgtgctaaattcaagttttcttcgctataattgagctggctacgataatgtgccgttaataagaaataacgcaccgcttctgcattgtagtggtttaatacatcacgaattgtgaagaaattgccgagggatttcgacattttttctttatccaccataatcatgccagaatggatccaataattcacatattggccgccatgcgcacagcaagattgtgcaatttcattttcgtggtgagggaacattaaatcagagccaccaccgtgaatatcaaaatattcgccaagctgtttgcagttcattgcagaacattcaatatgccaacccggacgacctgccccccaaggggaagcccaacttggttcgttttctttcgacattttccaaagcacgaaatccattggatttttcttgatttcattgatttcaatacgtgcgccagcttgtaattgctcaagatcttgacgggataatttgccgtattctttgaagctttctacatcaaacatcacgtccccattatccgcaacataagcatgtccgcgtttaattaatttttccacaatttcaataatttctggaatatgatgcgtcgcacgaggttcaaaatcagggcgtaagacattaagtgcatcaaaatctttatacatttcctgcaccatgcgatccactaactgatcgcaggtttctttgttttctaacgcacgtttaataattttgtcatctacgtccgttatattacgcacataagttaaatcgtaacccaaagaacgtaaataacgggcaatcacatcaaaacacacaaaagtgcgtccatggccgatatggcacaaatcataaacagtgacgccgcaaacatacattcccactttattttcgtggataggtttaaagatttctttttctctcgttaaggtattgaaaatttttagcatttttaagctcgtaaaatgaaataaaaacaaaccgcacttttatagcacttttacctcgattgtggaataatacaacccttaattttttagagggaaaacaaaatggttacattacacacaaactttggcgacattaaaattaaattggattttgataaagctccagttacagcagaaaacttcttaaattactgcaaagacggtttttataataacacaatttttcatcgtgttattgatggctttatgattcaaggtggcggtatggaaagcggtatgcgcgaaaaagcaactaaagccccaatccaaaatgaagcgaacaatcgtttaagtaacaaacgtggaaccattgcaatggctcgcacttcagatccacattcagcgacagcacaatttttcattaacgtggcagacaatgatttcttaaattatcgttcaaaagaaatgtttggtcgcgaagtcgttcaagaatggggctatgcagtatttggcgaagtggttgaaggtatggatgttgtggataaaatcaaaaaagtgaaaacaggcaacaaaggctttcatcaagatgttccaactgaagatgtagtgattacatcggtttctattgagtaacaaatgagcataaaacaacatcgccctaaagttggagaaattctagaatgtgattatggtcaattttcgcatacctgtcacgttgatggacatattccacctgaaatggttaaaaaacgtttggttgttgttttgaatgctaaactgaatgggcttattttagttgcaccaatttcatctaaaattaatttagatggtataaaaaatggctatcatattgaaatagattcagaattaataaaagcaacaggcttttatgataaaaggactcgctggattaaatctgaattaattcaatcagtaagtcgtctccgtctgtatcatatttatgataaaggaactaaaattactcaatatttgccaagggatgttgtaacaaaagttcaaagagctatcataaaagcaatcaatgcaagctcattacttgacaagtagatagaatacagtatagacttccgagcgtaacgccttagagcgatcatcatcgaaagatgagtttttaaacgccattgagcgatgaatcccctgattagcgataattaggggattttttatagaatttagataaagatatttatgcacttcttcgacactcacacgcatcttaattatctccaacaatttactggggaaccgttgtcacagcttattgataatgctaagcaagccgatgtgcaaaaaatactggttgtggcggtgaaagaagctgattttaaaacaatccaaaatatgaccgcactttttcctgataatttgtgctatgggcttgggctccatcctctttatattcaagaacacgccgaaaatgatttgattctgttagaacaagccttaaaaaatcgtgatacaaattgcacggcagtggcagaaattggtttggaacgcgcgattcccgatttgctcaccgatgaactttgggcaaaacaatgtcatttttttgaaagccaactttatttggcaaaacaatttaatttacccgtcaatattcacagtcgaaaaacccatgatcaaatttttacttttttaaaacgtattccattatctaaacttggcgtggtacatggtttttcaggaagttacgatcaagcaaaacgctttgttgatttaggctataaaatcggagttggcggcactatcacttatgaacgagccaataaaactcgtcaagcaatcgcgaagttgccgcttgatgccttagtgttggaaacagacagcccagatatgcctgtatttggttttcaaggccaacctaatcgaccagaacgtattgtggaaagttttaaagctctttgcaccttaagaaatgaacctgctgaattgattaaaaaacttacatgggaaaatgcttgccagattttttcttgatccacgtcacattactgaaattattttgaattaaatactagaaaaaagaaactggcataataatatccgcctcgtagaaagtttttctcaacacacaataaggatatattatgtcgcaaatctatactcaggtgagaaagttagcggaacagtttattgagccttacgccgacgaactcgatcaaaaaaagaggcatttaaggaattaggtaaagctggttggttttcacttttaattccaaaagaatacggcagaatgggattaaccctaaaagaacacgctgaagtctgtatggcattagctgaaagttcagcctctgctggtctctgttatatgatgagtaacgttgcagtgaattgtttaaatctattcggcagctatcaactcaaacaaaaaatcttttctgacattgttcaaaataaaacctttgccgcactcgcctatagtgaattaggcacgggtactcacttctattcgagtttttacatcaacatggcttggaatttggtcaagattatgtagaaaaacgctttgatgtgggtgttggtttgcacggtgatcatgtaggcggtgaattaaattcagccaatgcattcaccgaaaccttgttcaaaatggattacaacaatccagaacataaagaaatgatggatttggaaggattaaaacgttggattgcgcgcagaaaaagccttaaattaccttccaccagagcaaatatcaaaatttcagacaaaaaattgccccattaaggggcaatcttatcaatgttctaaagttacttatagctttaaacaacgattaaatatgttggttaatgaagttagccaattgagtttttggtaatgcaccaacttgagttgcaacaacttgaccatttttaatcaataataatgttgggatactacgaacaccaaattgtgctggcgttgcttggttatcatccacattcattttcacgattttaactttacctgcaaattcaggtgcaagttcatctaacactggtgcaatcattttgcaaggaccacaccaaggtgcccaaaagtctaataaaatggggatatctgaattaactacaacactttcaaaatctgcgtcattaatgtgtaatacttcgctcattttgttttccttattttgtgaatggaatccctatataagggctttttttaaacttacaagtgcggtgcagaataacaccgttttaaaaaatgtaaactaatcgttttaattgccgaaaactaagacggcaaaacaatattttcacacactttacccgatttcaatttataaatgtttgataaagtcacgtctgcaatattggttagtgcttcttcggttaaaaacgcttggtgacctgttagcaatacattatggcaagaagataaacggcggaaaatatcatcttgaatcacttcgttagacttatcttcaaagaataaatcacgctcattctcgtaaacatccatacctaacgcaccgattttacgctgttttaacgcatcaatcgcagcttgagtatcaatcaaagaaccgcgactcgtattaacgatcatcacgccatctttcatttttgcaaaagcctcgcaatttaataaatgatagttttctggcgttgctgggcaatgaagcgtaatcacatgagatttagcataaagttcatctaattcaacatattgtccccccagttcttctactactggatttttgaaaggatcgtacgccaagatattcatgccaaaacctttcaaaattcgcatcactgcgatcccgatttttcctgttccgattacgccgactgtgcgtccgtacatattgaaaccaattaacccctcaagagagaaattcgcttctcgggtacgctgataagcacgatgaattcgacggttcagagtcatcatcaaaccgatggtatgttccgccaccgcttcaggcgaataagctggaacgcggacaacttggatgcctaattcttgagctgcttttaaatcaacattattgaaaccggcacagcgcaaagccacaattttcacaccaagtgcggctaatttttctaatacttttcggctaccattatcattcacgaaaatgcatactacttcgcaatgttctgccaaacgcacagtgctctcgttcaacataaaatcaaaaaattctaaatcgaaattatatttcgcgttaatgagctcaatatattttctgtcataacttttagtgctatagattgcaattttcatggtttgctccaattattttaagtttgcaaaagcttgtaataagtccgctttaatatcttctacatcttcaataccgactgaaaaacgcaacaaggtattagtaatcccacgagctacacgctcggattctggaatatccatatgagtttgagtggcaggataagtaataaaactttctgtgccgcctagactttctgcaaaagtaatcaatttgatggattttaaaaatgtattaacccaagcttcatcttgcaaacggaaagacaacatcccacctttattcggataaagcaccgattccacttgtggttgagcttttaaaaattccgcaatagcttgtgcattttcttgatggcgtttcatacgcaaagaaagggtcttcataccacgaatagtcagccaagaatcaaaaggagaaagcaccgcccctgcaccattttgaatataagcaatgcgatcacaaagttcttgccctttcgcaacaattaaaccaacaagtgcatcattatgcccagcaatatatttagttccgctgtgaattaccacatccgcacctaaatctaatggacgagaaagcacaggcgttaaaaacgtattatccacgatcaacattaagttatgttttttcgcaagttttgcaatttcaaccacatcacattcttccattaaaggattcgatggggtttcaataaaaatcgctttcgtatttgggttaatggcagcctcaattgctgaagcagatgctgtattaacataaacaggttttacactattgttatttttataagaaaaatctaataatcgataagtaccaccatacacatcgctagaaacaatccattcatctggggcggtaaaaagcgtcatcaaaacttgaattgcagccataccagaagaaaacgcaaaaccacgatctccattctctaatttagctatcgtttcttctaatactgtgcgagttggatttttggtacgtgtgtaatcaaatcccgtactttcaccgataccacaatgaccataagccgtagaaagaaaaattggtgcagaaaccgcgcccgtacgctcatcactgcgattgcctgcttgagctaataaagtatcgatagcatattgttgtgtcataacatcctctaaaaataatgaaaaaattgaccgcactttacgtgttaaaaaacgtttagcattttggcacaaaggaaaaagtgataaaagtagaaattagaaaattacataaaatttcatttttccatcattttctgtgatttatttgaacaaaatgaactttttttaaacggttagacaatttttttaaatctgtaattgacagttatctgaatttccgtaaaatgcgcaccaataacagcgaatgcgggaatagctcagttggtagagcacgaccttgccaaggtcggggtcgcgagttcgagcctcgtttcccgctccaattcgtggcgtgttagcaaagcggttatgcactggattgcaaatccatgtagctcggttcgactccgggacacgcctccataatacgcaaatgttagttgtctatatgcccgagtggtggaatcggtagacacaagggatttaaaatccctcgcctttcgaggcgtgccagttcaagtctggcttcgggcaccatttaaacaccaatccaaagattttaaaatttactttaaaatcatctaattgggtcgttagctcagtcggtagagcagcggacttttaatccgttggtcgaaggttcgaatccttcacgacccaccacttaaaaataaagtaagcaccgaaaggtgtttttttattgcctaaatctgatactactttttaaattacttgcttattgaaaaatagctattctctccatccaatctaaaataattaatatattttatcgctacgttatactttctaaataaaatagcacctgaaaatcagatgctatccaaaacacaataaaaatttaccgcactttatgacttcaataagtaagcccgtagttgtgcaaaatcattatccatttcatctgaaagcaatggtagctgattatgtttatccagtgtttcaggtaatggaagctgaataccaagaatacgttctacggattctttaaatttcgcaggatgcgccgtacacaggaagattcctgtttcactcgctttaagttgatctttcaacacctgataagctatcgcaccgtgaggttcacataaataacctttcgactgcatcgcttttaaggtatcttctgtttcgctatcacttagcatccccgaacctaaatcagttaaatcccaaccatttcgtttaaacaattcctccactcttggccaattatttgggcgacttacatccattgcattagaaagggttgcaactgtcgttttaggatcccaattacccgatttcaaataacgtggcacagtatcatttgcgtttgttgaggcgacaaagcgttttattggcaagcctaaggtttttgcaattaatcccgcagttaagttaccaaaattaccacttggcacagaaaccacgacattatcacgtttttcttttggcaattgtgcgacagcttcaaagtaataacaaacttgagctaataaacggctgatattaatagaatttgcagagttaagcccgatagcttggcgcaattcaacatcatcaaaggcttgcttaaccaaagcctgacacgcatcgaaatcagcgttaatcgcaacagtacgaatattcccacctaaagtacagaacagcttttcttgcaatgggctgattttgccttttggataaaggataactacattaatattttctaatccataaaacgcatgtgctacagcggctccagtatcgccagacgtagccgttaaaatagtaattttgccatcgccacgtaccgcagcaagtgcctgtgccataaaacgcccaccaaaatctttaaatgctagcgttggaccgtgaaataattcaagtgcataaatattttcttccactttttctaacggtgcaggaaaagtgaatgcatttttcaccatcgcatctaacgttgcttgtggtaactcgccatcaattaatgcacctagaattttttgactacgctcaacaagaggcaattcaagtaattcattaatgttattaagttgaggaataacttctggaaagaatagaccttgatcccgcccaagaccttgacgaacagcctgagaaaaagtgacttgttcttctgggtgtttgatattgtataaattcatatttaatccgtttttaatctgatttcatctatttaaattaacttatttaatttctcttgtgccttcgttatcaactttacatacatgcacaaaaccttcattattttgtaaataatggctttctaaataacttgaaagtttaattgcagtttgtaaatcaggggcaatagagaaaatagttggccctgagcctgaaatacctgtggcaagtgcgcctaagtctcgagtagcttgttttacttcagcaaaattaggtaacagagattcacgataaggctcggcaatgacatctttcatcataatcgcggcaagattttcctgatgggtatggcaagcatgcacaaagccacctaaatgacgaccatgggcaatcacgttttgtcgagtatagcttttcggtaaaattgctcgagcttcagcagtagaaacttcaattcccggataggctaacacccaataccaattatcaaaaaatggcaatttttgacaaatattgccgagcgattgcaccataaattgcacaccgccaagatagcaaggtgcgacgttatcataatggattgaaccagaaatacgaccttccaattctcccatcatttcaagcaattccattttcgaaaaaggttcattatgaaactgatttaatgccactaatgcagcaacaatagaacaagcactagagcctaaaccagagccaataggcatatttttttcgagcgttaaacgtaaaggtttaacatttgctccgcgtaattttaattgctcgctaaatagcacataagcttggtaaacaatatttttttgcggttctttcggtaatttacgaacaaaatagcccgcactttctaactcaaaaccagttgaaatagattctatttgaaccacatcgcctaacaaagaaccatcaataggagagatcgcagcacctaaagtatcgaaacctacgctaatattcgcgctagatgcaggggcgtaaattcttaacattgggaatccttattaatgttgtaatgttcttaaaatatctgcaaagatacctgccgcagtaactgcattacctgcgccataaccacgtaataaaagtggaatcggctgataatagcgagtgtaaaatgccaaggcattttcaccatctttcactttataaagtggattattcagatctaccgcaacgatggatactttgcattttccttcactaatttttccaacataacgcaatactttgccttctgctttagctgtggcaacgcgagttttaaattcttcatcaagctgaggcaacattgccataaactcatctgcagattttccatcggagaagccttttggcaatacaccttcaacttcaacatctgaaagttcaagttcaattcccgcttcacgagcaagaattaataatttgcgtgctacatcttgtccagaaagatcatctcgaggatctggctcagtaaagcctttttcacgcgcaagtgcggttacttctgaaagagaaagtccttcttccaacttaccaaaaataaaggaaagcgagccagataaaatcccttcaaaatattcaagctcatcacctgctgcaagtaagttttggagattttcaataactggcaagcccgcacctacattggtttcatataaaaatttatgctggcttgcttgggcattttggcgtaactcattgtaataaactaattctcgtgtattcgcttttttgtttggcgtaaccacatggaaaccttcttttaacgcacgagcataaagccctgctacagattcggctgaagtacaatctacaaatactggattcaccacatgatgtaatttaatgaaagaaagcaatacatcaaaatctgatggctgagtcgcattttctaaatcgtttttccaatcctctaaatttaatccattttcatcaagcaacatacggttggaattcgcaatagcacaaactcgaatttcaacattcttctttgctagatactccttttgacgctttacctgctcaattaattctccgcctactccaccaacgcccactaaaaacatatccacgacttttttattattgaaaagcgcctgatgggtagccttcaccgcttcaatggctttattttgcggcacaaccgcagaaattgaacgttcgctagatccttgtgcaatcgccacaatgctaatgtttgcctgcgctaatgccgagaagaaacgagcagcaatgcctttcgcttgcttcattccatcgcccacaacagaaataatggataagtctttaatcacttcaattggttctaattgatgttcatttaattcattagcaaactccgtttctagtacggttttcgctacttctgcagatttcacaggcacacagaaactaatactatattcagacgaagactgagtaattaaaataactgaaatgcctgcgcctgacatggctgaaaatacgcgagatgccatgcctaccataccttgcataccagggcctgacacattaaacatcgccaaattgtctaagttagtgatacctttaacttgcaaactttctgatttcacattgccatcaataatcgaacctggtgcagaaggatttcctgtatttttaatgacacaaggaatattttgtggcaacaatggcccaatcgtacgaggatgaatcactttcgcaccgaaataagagagttccatcgcttcacgataagaaagcgttggtaataaacgtgcatcaggcactaaacgcggatcgcaagtataaacgccgtccacatcggtccaaatttcgcatacacttgcgcctaaacaagcggctaaacaggcggcagaatagtctgagccattacgaccgagcaataccaactcgcctttttcattacccgcagtaaaacctgccatcagcaccactttatcttttgcgatatttgctgcatcaacacgttttgttgattcttcaatttcaacagaagattcaagataaccgccttttgccaataattgtttgacaggatccacaatatgtacgctatagccacgcgcttcaaaccaagctttcatcattgcaatagaaagtttttccccacggcaatcaatggtcgctttaactgcatcttctacttttcctgcctgacggatttcttctaataatcctttaatttgaacaaattcagcatcaataagtgctttggtaccatttaagtcgaattgattattttccgtatgtaagccgttgatgatgttatagaaaatttcgattgcttcgttgaaatgcgtatcggttgattgatttaatgctgctttttcagaaagggcgacgagatggttggttattttggctggtgcagataaaacacctgcagcctgctcttctaaatgagcttgctcgatcaatttcgccgcttgggaaaaacgttccggatttgcaagcgaagtgccgccaaatttaagtacgcgcataattggttctcctagatattgtgtttttaaatttataaaaaaacccgctattcagttgaatcgcgggttttctgtatcttgtttttgctgcactaacccgcaccattaatcataataatggtcatcataatggcggtaatcgtgctaatgattacggataaagtgcggttatttttcattgtgttttatcttgaaaaatgaatgcgtaaagaaataccgaaatttcccgagcttgtcaaacagaaagtgacaaatttttcagaaattttcttagtcaataaatttcgtgtaaactaaccgcacttttttataaaggaaaacctatgaatatccagcataatctcaacctaattcagcaaaaaattgaaacggcttgtaaagaagaaaatcgcaatcaaaataccgtaaaattacttgccgtatctaagaccaaacctatttctgctattctttcggcttatcaagcgggacaaacggcttttggggaaaattacgtgcaagagggggtagaaaagatccaatattttgaatcgcaaggaattaaccttgaatggcattttatcggcccattacaatcgaataaaacccgtctcgttgcagaacattttgattggatgcaaacgcttgatcgagcaaaaattgcagatcgtttaaatgaacaacgaccgaccaacaaggctccattgaatgtattgattcagattaatatcagcgatgaagaaagtaaatcaggtattcaacctgaggaaatgctaacactagcaaaacacatcgaaaatttaccgcacttatgcctacgtggcttaatggcaatacccgcaccaaccgacaacatcgcagaacaagaaaatgcatttagaaagatgttggagctgtttgaacaacttaaacaagtcttacccaatcaacaaattgatacactttctatgggaatgacggatgatatgccgagcgcaataaaatgcggttctacaatggtacgcattggcactgcgatttttggtgcgagaaattattcaacatcacaaaataaataatcatggaataaggcccgaatttaaaacaagccttatttcttaatgaaatttaaatgccagtactctcgccacattttgagcggtagaaattaaattttgttcgccttgtttgagaatatccgataaatcgccaagttggtgaataatagggaacaccgcatcaataccgtgatcaaacaccacatcataatcttcacgcaaacaccctgcgatggcgatcactggcttattgaactgttttgccgtacgtgccacaccaattggcgttttacccataatactttgtgcatctattcgcccttcacccgtaatcactacatcagcatcttttacatagtcaattaaatgtaaccggtctaacacaatttgtatgcctgctttcagttgtacgcttggtaataatagcaagccaccacccataccaccagcagcacctgcgccagcctgatcacgaatttgtttaccgcaatcgcgttcggcaatttcagcaaaatgcgaaagtgcagcatcaagttgtttcaccatttcaggcgttgcgcctttttgtggtccaaaaatggcagatgcaccacattcaccacagagcggattattcacatcgcacgctacttcaatgtgaacttgttgcaaacgtggatctaattgttgaacgtcaatcttcacaatatttgctagctctgctccaccaaaaccgataggcttatcttgcgaatctaaacattgcatccctagtgcttgcaacattcctacaccaccatcgttggttgcgctaccgccaatgccaagaatgaaactctctacgcctaaatctaatgccagtttaatcaactcccctgtgccgtaactggtggtaagcaagggattgcgtttttcaggcggaacaagatgtaaaccagaagctgctgccatttcgataatcgcggtttttccatctcccgataaaccgaagaaacttttcactttgtcacccaaaggcgcggtgacttcacattcaatgagcttgccttgcgtggcatccacaagggattgaactgtaccttcgcccccatctgccattggcaattttacatagtccgcatcggggaatacacgtttgaagcctgtttcaatggcggtagcgacttcaagtgcggtcaaactttctttaaaagaatcaggtgcaatcacaaatttcataacaactcctagaatttaaatacgccaaaaattaaggtagaaacgatggtcatcatcaaaccgaccgcactttcataaggaataagttttaaacgttctttgatatccatattcacactaccgcctgtggcatggaagaaagaaccatgtggcatatgatcaaatacggtcgcccctgcatgaatcattgctgcaccagcaagactgctaactccaagttctaacaaggtactactgaacacattggatgccaccgcagtacctgccgtggtagaagctgtcgctaaagacatcaacacccctgaaattggtgcaagaatgtatgatggcaaacctgaatgttccaaaccttgaatcaatacttcttttaaaccagaattagcaatgatgccagcaagcgcgcctgtaccaagtaacataattgccacgggtgtcattttactcaatccattgatagcataactatttatattgcgaagtttgcccatacaaaacgcaccaatcaaaccacctaacggcaatgcaattaatggatcaactttaatatcaaacaatggacgaagtgccaatagcaaaattgccactaaaggtgcgacaagtgcggtcagaaatgaaggtaaattttgcgtttcaagcacgattacctctttgtcagtcactttagaacctttgttgattaagcgttttgctaagaagtaggtgagaatcaaaccaaatagcgcgggaattataccagccatcatcacggaagtgagtggcaaatgaaaagtatctgctgccgcaatggcatttgggtttggcgacataatattaccagctttaccaccgccaatcatggcgagcaaaattgcagctttcgataaatcgctgcgacgcgataacgctaaagcaattggtgaaacagtaatcactgccacatccacgaacacacccaccgcagttaaaatcatcgtcgctagtgccaaggcgagtaaagctcgagtttcacccaatttattagtaatggtttccgtgatggaatttgctgcacccgattcaatcagcacaccggccaacacaccagcagctaagatacgcataaccgcagtagtaataccctgtgcgccaccgatcattaggctcactgtttgcgataaatccgcaccaccaattaagcctccaaccaaagctcccactaacataccataagctggtgagacttttttcaaaatgaggaagatagcaacgattaacgccaccaacgcacctattgctgagactgttgtcattttttctctcctataaaaattaaaaccaaggagattatttctgttttataggggaaatgctttattagagcaaacaaaaagtgcggttaaaaatcatcaaactttgtaaagttatacaacctcaatgttctaacaacgttccgagatagagcgttaatttatcatctatcttattgaaaaataagccagttatttgctctattttgttcaatcgataacgcaaagtattcgggtgaacaaataatttttccgcagtgagataaagatcacaatttgataaaaaatattgttgaagggttttataaagtatcgcatttycttctgagaaanggggagaaaggggttttatcaattcgttcccttgccaagaatgggataatccagcaagtaacacaggcaatcgatgctcatcaaacacataaatacctttgcgtggatgatgttttaatccataagaaagcgtgctttgcgcactttgaaaagacaagggaagctgctcaaaaagcggtagatttagacaagcgcctacagcaattttataatcttgttttgaataatctgcaggtaaaagcgttttcatttgagcagaaagtacggtggagttttgccaagtctttaagaccacaacctgatcaagggacaaaattgccacatcctgtgcaaattcagactgttccaaataattgatcagattctgtaaattatccagggctggattaagtaacttaatcaatacaaccacacgagatttatttaaatcaaaagaaaaaaatttcgcctgctgttccatctctttccaattcaaattgcaatgtaataattgtaaaataaattcttctttgtaacgacgatgccagctttcttgttcgagtaaagcctgttgttccacaataagttctgccgtcattttcactagttcggcatattgtttcacctgagttggctcaccagaaatccccaccactccaatatttttgcctaaataatgaatcggtaaattaatccctggttgtgcttcaaaattccatttttgtgccaacgcttgatcaatctctaccacacgattttcccgcaacgccaacaccgctcctgtgtgccgttgattcaaacgcgttgaatttcccgacgcaatgatcacaccgtcgtgatccattacatttacagagtgatgaatgatcttcattgcacgtttaacaatttttttggcagtgtatttgtcaagttgcatatttgtaataaagaagataaatgaagataaaatattgagaaaaagaaagttagtcaaatattgttttatctgcaagaaaagacgggagactattctcccgcactgcgtttttatcgctataatgttttattctgaacttgaacatatcccataattaatgccaaaatacctagtggaaaaatgagatctattacagaaccatcatttccccaaatcaagaatagctttgatgaaaataattaaaatcggtaagacaataggaatactcacgacatagcccgtaatggctaatgcccattcttcctttttcttacctagaaatttgataaagctgaacgccattttttcagcaactgggcagattgaagtttcaccatgtaaaggttctcgaataatgctacttacaaaggaagaagtcgctttatttggttttcctggacggatacaaattgtgggcaggcgaagacagagaccatcaacaaaaccttttcttgtatagtcattaataagtaattcactcattgctttttgtgcaccataagtcgattgtggcgttacagcagtagaatcctgaataatttctggtaaatcaccaccaaatacagcaagtgaactagaaaaataaaacgaattttagtatcagattcatcaaaatatgggaaagtggcgacattccatatttgtccactaacaaattttgatcacataatttgcgacaaaaatcttgttgaatctgcacagaatggcattagagaattaaatattaatttaactatcgtataaataaattaatataaatgatctgcaccccaaaactaaacaaataagcttactcattaaggtgcaaatcaaagtgcggttcatttttatattatttttggctacatacagcaataaaatgtaatttatgttcaggatcattaaaggttttgaacattcttttaaattgctcacgattttccgctttcatcgcattacggatgatttttaacgtaccgaaaattccttcatcataaatcattccttttggggaaagtaatgtcatctcaccagagaaagtatcaacatttctaaaaccactttcttggaatatgcctttccatccatctttcgttaatggcgtgacagtcacgttaatcgctttgcgcatattttctagaatagtttgatgatcattccccaccagcataacatcgtgagtaagcaataaaccattgggttttaacactcgaaaatattctgcaatggcttttttcttcgcttccacgggtaacattgtgagcatcgcttcattgatgacaatatcaaaactttcatcctcgaaaggcaacttcatcgcattcgcacgctgtacatgaattttttcctgcaagccatttgcttcaatatttgcttgtgcttttgctaacgcattttcatctaaatcaacaccttcaatatgacaaccaaattgtttcgccaatccaattgcagtcgtccccatattacaggcaacctccaacacttttttatcttggctaaaaccgccattagcaattaaccaatctgtcgcttttttaccgcctggacgcaaacgcgttttacccaaacgtgcaagaaaattatgccctacttcatcttttgccatttttatctcctagtaattaacttggtttttatattatagataaaaatgataactattaaaatgtcagatcaaataaatanggcggaataattgttccgccttttcctattatttcttcaatgcttttttcaattcaagtaattcacgacgtaactgtttcaattcgctttccatttcagcttgtttatacagttttttgtcggtttctgcttgttgagagcgcatcatcactacttcttgtcacaattgcaaaacttccgcagaattgaccgcactttgtgttgaaacttaatctctcaagcggtttattatccagatacgaaatttgttggtgtggatttagcggatagtcaaattacccaaggtaatgaaattattcaatcaatgggcttaacaaacgttcgtttgcttgaatattttatttatcaagttggttcatttactattcaatctttaacacagcatattgaggaaaataaagaatttgccaatattactgaaaatgaactgtattctgcggtgctatctttagttattttaggttatgtctatgtttatcttacgacctatccaatttattcctttgaagataacaaaacttacataccgaaaagctttactcaatatgtaaaaacattggtagaaggcgcaaatcagtatattggtgctggaaatatgtataacggcgacgtagaagatttgaataaactgcatctttatataatgtctcaaatggaaaaaccgacaactaaagctgaattgaaatcagcattacaaggctatttaattcaaaatgaatatcaagatatgaataacaatgataaattgattgatgaaacttatgattgcactgagttgtttaatgcgctttttgatgtattaacaagattaggtatatccagcctgtaaacctataatctgtgtatggttcgtttaatgtaccgttttgtttttcatctaaatatcaatttaaattgagaactatttgcatttaaataaaattaggcatagaatagccacaattcaggctgaactgaataatttgcactcaacataaggagcttttcaatgcaatttaaacatttcaaacttgctacccttgcggcacacttgctttttctgctaatagttttgctgatattaccgtttataatggtcagcacaaagaagccgctacggctgtggcaaaagcctttgaacaggaaacaggcattaaagttacgctaaatagcgggaaaagtgagcaacttgcaggtcaattaaaagaagaaggcgataaaacaccagccgatgttttctacactgaacaaacagcgacttttgccgatctttctgaagcagggcttttagcaccaatttcagaacaaaccattcaacaaaccgcacaaaaaggcgtaccacttgcaccgaaaaaagactggattgcattaagtggccgttctcgagtagtggtttacgatcacactaaattatctgaaaaagatatggaaaaatcagtgcttgattatgcaacaccaaaatggaaaggcaaaatcggttatgtatcaacttctggtgcgttcttagagcaagttgttgcgttaagcaaaatgaaaggggacaaagttgcgcttaattggttaaaaggtttaaaagagaacggaaaactttacgctaaaaatagtgtggcattacaagcggttgaaaatggcgaagtacctgctgcgttaatcaataactattattggtataacctagcaaaagaaaaaggcgtggaaaacctaaaaagccgtctttattttgttcgccaccaagatccaggtgcgttagttagctattcaggtgcagcagtattgaaagcctctaaaaatcaagctgaagcacaaaaattcgttgatttcttagcgagtaaaaaaggtcaagaagcattagtggcagcgcgtgcagaatatccgttacgtgctgatgtggtttcgccatttaatcttgaaccttatgaaaaattagaagcaccagtggtgtccgcaacaacagctcaagataaagaacatgcgatcaaattaattgaagaagctggattgaaataatccaaatattgcgtgcgtgtatttgaaaaaattcacgcacgcgtttacaattctctaacaaaattaaccgcttgcgtgcgtgaactgaaaagttcacattcctaaaaggatttaactttgcctcgcagaccgccattctggctcactttacttatcatcttaatcgggcttccgttatgtttgccgtttctgtatgtcattttgcgtgcgacagaagtgggattaacgcgaagtgttgagctattgtttcgccctcgaatggctgaattattaagcaatacaatgcttttaatggtttgtgtaactatcggtgctatttcacttggcacgttttgtgcttttttacttgaacgttatcgcttttycggtaaagctttttttgaagtggcaatgacgttacccctttgtattcccgcctttgtaagtggttttacttggntcagcctcacattccgcgttgaggttttttggggaacaattggtattatgacattaagttcatttcctttggcttatttgcccgtttccgccatactaaaaagacttgatcgttctcttgaagaagtaagcctttcgcttggtaaaagccctgtgtataccttttggtatgctatttccccgcaacttaaacccgccattggtagtagtatcttactgattgctttacatatgttggtcgaatttggtgcagtgtcaattttaaattatcaaacctttaccactgccattttccaagaatatgaaatgtcttttaacaacagcactgctgcattattatccgccgttttaatggcgatttgtatacttattgtttttggggaaattttctttcgtggaaaacaaaccctttaccacagtggaaaaggcgttactcgtccttatctcgtaaaaacactttcctttggaaaacaatgtttaaccttcggatttttctctagcatattcattttaagcattggcgtgcctgtgattatgttaatttactggcttattgtgggaacttcacttgaaagtgcgggtgatttttcagaatttttatcggcattcagcaattcatttatcatttcaggcttaggcgcattgcttaccgtaatgtgcgccttgccattagtttgggcagctgttcgttaccgtagttatttaacgatttggatcgaccgcttgccatatctattacacgctgtgccaggcttagtcattgccttatcattagtctatttttccatccattacgctaacgacctatatcaaaccttttttgtgattatcattgcctactttatgctctatttgccaatggcacaaactacattaagagcgtctttagagcaactttccgatcaaattgaaaaagtcggacaaagtcttgggcgaaaccctttctatatttttcgcaccttgacgctaccagccatattaccaggtgtggcagccgcatttgctttggtttttttgaatttaatgaaagagcttaccgcgacgcttttgctcacatcaaatgatattaaaaccttatccattgctgtgtgggaacataccagcgatgcacaatatgctgctgccaccccttatgcgttaatgctcgttcttttttcgggtattcctgtatttttattgaaaaaatatgcgtttaaataaaatgataaataatccgttattaaccgttaaaaatctcaataaattttttaatgaacaacaagttctgcacgatatttcattcagcttacaacgcggagaaatcctctttttacttggttcttcaggatgtggcaaaactacattattacgtgccattgcaggttttgaacaaccctctaatggcgaaatttggctaaaagagcggttaatttttggcgagaattttaatcttccaacgcaacaacgtcatctcggttatgtggtgcaagagggcgtactttttcctcacttaaatgtctatcgcaacattgcttacggattaggcaacggcaaaggaaaaaatagcgaagaaaaaacgcggattgaacaaataatgcaactaacgggtatttttgaactggcggatcgctttccacatcaactttcaggcggacaacaacaacgcgtagcattggcgcgtgctttagcccctaatccagaactgattttattagacgagcctttcagtgccttagacgagcatcttcgccaacaaattcgccaagagatgctccaagcacttcgccaaagcggtgcttccgcaattttcgttactcacgaccgtgatgaatccttacgctacgctgataaaatcgccattattcagcaaggtaaaattttacaaatcgatacacctcgcaccctttattggtcgcctaatcatcttgaaacagcaaaatttatgggggaaagtattgttttgcctgcaaatctactcgatgaaaataccgctcaatgccaattaggcaatattcctataaaaaataaatcaatctcacaaaatcaaggtaggattttgcttcgtccagaacaatttagcctgtttaaaacatcagaaaatccaaccgcactttttaatggacaaataaaacaaattgaatttaaaggnaaaattacctccattcaaattgaaattaatggctacgcaatatggattgagaacgttatttctcccgatttatctattggcgataatttgcctgtttatttacatagaaaagggcttttttactcctaagaataaagccttatcttcacgataaggcttatttttaaacaatatattcggaaaaaatttgttcaagatgtgatattaaacagtctgcgcctaaaatattttcccctttccacgcctgtggcaaaatctctggagaaaattgctggcttgccaattcagctaacggcaaataactgatatgccaaggctcccgccccactttcttattggactgcatattcataaaaggcaaagcaaaatcaaagtgcggtaaattttcggcaagaaattcactcaattcaaagaagtagccgcctttttcatattcccaaggctccagttgtaaagattgacctcgtggcaaaagatcaggatcaaaaatatccacttccgttccccaatgatgacgactagccgcagtaatgcagaccaacgtaaaatcgcctgacatttttgccagtcatctaattgattcaaatctaatgcctttcctgcatcatcgtgtacttttcgctcgcccttaaatttactgttccaaataagttgttggcgttcaaaatcacgaaaactgctcgcaggctgtaaattaaagccattttttgccgcactttgttgcaaagcttgaaatgcttgcacagcttgcgtttgcaaaaaatgatttgatgaatgagttgtgggtaaattgactaaatgctcacgggactttcctgtaagcatttctggggttaatttcattttagctatccaataaattcactaacattttgtggtaaatttcaccgcacttgccaaggtcttctacactgacacattcattgactttatgaatggttgaatttaacgggccaaattccactacttctgcgcccatcaatgcaataaaacgaccgtctgacgtgccgccacctgtttcagcctttggcgttatgcctatggtttcctcaatagcggaggttatcgaatctaataatttacctggttttgttaaaaagggtttgcctgataaattccattcaatacgatatttcaaattgtgtttttctagcatttcagccactttttgcttaatgatttcatccgtgacttctgtgcaataacgcaaattgaactgaatatataactcagcaggaattacattattacttcccgtacccgcgtgaatgttagcaatttgtaggcttgttggcgggaaaaattcattgcctttatcccattggtaagtcgttaattcttgcaaaaatagcgctgctttatggattgggttttcagctaaatgcggataggctacgtgtccttgaataccttgaatatagagatttcctgtaattgagccgcggcgaccatttttgacaacatctcctaagtttttagcactcgatggctcgccaaccatacaataagtaattttttcatcacgcgccattaacgtctcaaccacgtgtatagttccatcttttgcggtagcctcttcatcagaggtaatcaataatgcaatggtgcctttatgattaggatttgcttttacgtattcttctgccgccacaatcattgctgcaagggagcctttcatatccgccgcaccacgcccataaagcatgccatcaataatctccgcagaaaacggcggagacgaccattgattttcatcgccagtaggcacaacatccgtatgacctgcaaaagcaataactggctcgctcgttccgtgttttgcccacaaattcaacgtgtcattaaaaggcatccattcaatttgaaaacctaatttttctaaacgttcggcaataatttgctgacagccttcgtcatttgggctaatagacgggcgacgaattaaatcttgtgccaacgaaaccactttttctttcataaaaactcctaagaaaataaccgcactttaagcaaaagcagcctgatattccttttcattaaatccaattaatgcctttccatcttgtaaaataattgggcgtttaattaaagttggattctcagccaacacggaaagtgcggtggttttatcaagagaatttttaacttgctcatccaaattacgccaagttgtactgcgtttattcactaacacatcccagccaaattgagtttccgcttgggttaaaaaatttaaatctaacccatcaacacggtagtcgtgaagtttgtgttcgatattgtgatccgccagccatttcaacgctttctttactgtatcgcaatttttaatgccgtaaactgtaatcatatttcacctaaaaaagaaaaatcctcaatctaatcagactgaggattttaacccttatgctacttcatctcaaatgaattaacctaacaacttattgatacgtttaataaacgcagctggattttccaaagatccgcgctctgctaacatagcttgttcaagtaataattccacccaatcagcaaattcagtttcatctgcaatatcagccacttttttcactaaatggtgttctggattcagttcaaatgtgtattttacttctggtacaggttgccctgcggctgcaaacaatttcgccatttgggtcgtcatttgatcgttatccgtagaaaccaccgctggtgtatccgttaaattgtgagttaaacgcaccgttttcacacgttcgccaagcaagtttttcacacgctcaataaaactaccaaaggcttcatcttgttgtttttgtgtttcagattctttatccgctaaatcgcctaaatccaaatctgcttttgtaatactttgtaattgtttaccatcgaattcagttaaatagcttaacatccattcatcaatgcgatcggaaagcaacaaaacctcaatgccttttttattgaataattccaagtgcgggctatttttcgctgcaacataactatccgctgtaatgtaatagatagctttttgcccctctttcatacgcaagatgtaatcttctaaagagacagtttgctcgctaccatcattatgtgtcgaagcaaaacgcaataacttcgcgacagtttctttgttagcaaaatcttctgcagggccttcttttaagactaaaccaaactctttccagaattgaagatatttttctgcatcatcttttgctaatttttctagcatttgtaatgaacgcttagttaatgctttgcgtagtgcagccgtaattttgttatcctgtaaaatttcacgagatacatttaatggcaagtcattgctatcgattaaaccacgcataaaacgtagataattcggtataaattgctcagcatcatccataataaatacacgttgaacataaagttttaagccatgtttatgttctcgattaaataaatcccaaggtgctttagctggtacataaagcaaactagtatatgcttgatttccctcaactttgttatgcgcccaagtcacaggatcaacaaaatcatggcttaagtgtttgtaaaacgctttgtattcctcatcagacacatcatttttagaacgcgtccaaagggcatcagatttattgattttttcccatttttcgccgcactctttgccttcatcatcgtattctttcgtcagcatttccactggcaagccaatatggtcagaatatttaccaataatttcacgcaaacgccattcatttaaaaattctttttcatcttcacgtaaatgcaaaatcacatctgtaccacgggattttttctcaatatccgccacagaatattcgccttcacccgcagattcccaaagtacggctttatccgcctcttcaccagctgctctggtttttacagtcactttatctgccacaataaaagcagaataaaaacccacaccaaactgcccaataagctggctattttttgcttgatcttgaccaagtgcggttaaaaattcttttgttcctgattttgcaatcgtacccaaatgatcgatgacttgctcacgggtcatgccaatgccgttatcgctaattgtgatagtgcctttatccgcatcaaagctaacacgcacacgcaagtcgccatcgccttcatataaagcagggttggaaagtgctttaaagcgtaatttatctgccgcatcagaagcattagaaatcaattcacgtaagaaaatttctttgttagagtacaaagaatgaatcattaattggagtagttgtttgacttcagattggaatccgcgagtttcttgattttgtgacataattttttccttcataaagataaaaattgaacgtcacagatataagaataaaaagaaagatttcaagaggaatttaagaggaaaagtgcggtaaaaaaacacaaggaatttaaaccgcactttaaatgaaataaaaaatttcttatcccccttgatcgctataaatttatgtatataatgaattctgttttagatactagatagtaatttaatagtaatgaaacttggctagtgcattcccccactcctttcgcactagccatttttttgggaattttgtaccatatcccaactttttccaatcaacgatccattatgaataatcttgaacttgaacaactcattaatcaaaaactttcttctgataaaatcaatgactatgcgcccaacggcttacaagtcgaaggtaaaacagaaatcaaaaaaatcattactggcgtaacggcgagtcaggctttaatcaattacgcaatcagccaaaatgccgatgctattttagttcatcatggctatttttggaaaagtgaaaccccttgtatccgaggaatgaaaggcaagcgaattaaagcccttttagtgaacgacattaatttatatggctatcatttgccattagatgtgcacccagaattaggtaacaatgcacaattagccaaactgctcgatattgaaaatttacaaccattagaaaaaggctctgtgagtattcctgtttggggcgaattaaaagaaccgatgacaggtaaagactttgcagaaaaaatagaaaaagtgttaaatcgaaaaccgttaatttgcattgaaaacggaccgcacttaatccgaaaaattggcatctgtaccggtggcggacaaggttatattgatcttgctgcagaacaaggctgcgacgcatttattacaggggaagtgtcagaacaaacgattcattctgcccgtgagcaaggattgtatttcttctctgcaggtcatcacgcaacagaacgctatggcatcaaggcattaggcgaatggttggcgaaagaatatggctttgacgtagaatttaaagatatagataatccagcataaaatacaaaagtgcggtaaaaatatttcttttttaaccgcacttttatcttctgaaattatcgtttaaacattccgcctaaaccgccaagaccgcctaagcctccgcccattaagccttgcattccacgcatcattttagccatgccgcctttacgcattttcttcatcatacgttgcatttcatcgaattgtttaagtaatttattgacatcttgcacttgagtgccagagcctaatgcaatacgacgacggcgagatcctttgataatatctgggttggcacgttcttttagggtcatggagttaatgatcgcttccattttgacaaacattttgtcatctacttgatttttaacgtgctcagacaaattttttgcacctggtaatttctcaagcatagacatcatgccgcccatttttttcatttcgatcagctgttcgcggaaatcatctaaagtaaaatcatcgcctttcttgaatttctgcgccattttttccgctttttcacgatcaacagaacgttcaagatcttcgataagggaaagcacatcgcccatgcccaaaatacgggaagcgacacgatcaggatggaatggctcaagcgcctctgttttctcgcccacacccaagaatttgattggtttacctgtgatttgacgaatcgataacgccgcaccaccgcgcgcatcaccgtccactttcgtcaaaataacccctgtaagaggcaatgcttcattaaaggcttttgctgtatttgccgcatcttgaccagtcatcgcatcaacagtgaaaagagtttcgattggatttaatgcagcatggacttgcttgatttcgtccatcatttctgtatcaacgtgtaggcgacctgccgtatccacaatcaacacatcgtagaatttcagttttgcatcagcaagcgccgatttagcaatatcaacggggttttgtttaacatccgatggaaaaaaatccacgccaacggattgagccaaggtttcaagttgcttaatcgcagcagggcgatatacgtcagcagacaccactaacactttctttttatggcgttcacgcaagaattttgccaatttacccacactggtggttttacccgccccttgtaaacccgccattaagataactgctggtggttgggttgcgagatttaaactctcattcgcttcgcccatggctttttcaagctcacgctgaacgatttttaagaattcttgccctggcgttaaacttttattgacttcttccccaagcgcgctttcttttacttttgcgataaattcacgcaccacaggcaaggcaacatcggcttcaagtaatgccatacgcacttcgcgtaaggtttctttaatattatcttccgttaaacggccttttcctgtgatattacgtaaggttttggaaaggcgatccgataaattctcaaacatggctaacaatcctgtttttcttaaaaaattgtgctgattataccgaaatttaggcgtttttcatcatttcaaatgaaaatgactttttgagtaggcgatttcataaagaaagtataggacataaggaaaaagaatgattatttagccaatttcaggtattattctgcccactcttagctatttgagcagctatttgatttagcaaaatcaaataacaggtaaaaagtgcggtgaaaaatgaccgcactttttgttgattaacgaacaaaaggattttcccttggatagcattccccttagtactttatttattattcttattatctgtttagtgttatcagcctatttttctggttctgaaactggattactctccctcaataaatatcgtcttcgttttctatctgaacaaggcaataaaggcgcgaaaaaagcggaaaaactgctagaaaagccagataccttgttaagttttattcttatttttaataaccttgtgaatatcagcgcatctgcaattgcaacagtaattggtatgcgtttatatggcgatgccggcgtggcgattgcaacgggtttgctcactttcgtaatgctcgtattttctgaaatattccccaaaactgtggctgcaatgcacgcagaaaaagtgagttttttttcaagtcatattttaacttcattgcttaaaatcttttatccgctcgtttggttaatgaatatttttactaaatccttgatgcaaatagtagggttaaaacttgatatgcaaaaacaagtaattagtagtgaagaactgcgtagtattgtatcagaagcgggcgaagcaacaccaaatgaacaacatccacaaatgttgctgtctattttggatatggaaaccgtcaccgttgatgacattatggttccccgcaacgaaatcggcggtataaatattgatgatgattggcgagccattatgcgccactcaatcatgctgcacataaccgcgtggtgctttacaaaggcagccttgatgaacaagtgcttggcattttgcgcgtgcgtgaagcattccgcttgctccttgaaaaaaatgaatttaccaaagaaaccttaattcgtgccgcagatgaagtgtatttcattcctgaaagcacgccattaaaaacgcaacttgcaaatttccgtacaaataaagagcgaattggcttagttgtagatgaatacggcgatattaaagggcttgtgacgttggaagatattttggaagaaattgttggggattttaccacttccaccgccccaagcattgacaaagaagtaattcaacagtctgatggttcaatgattatcgatggctccgctaatctacgcgatctcaacaaaatgtttaactgggaattagatacagaagatgctcgtacttttaatggtttaatcttagaacacttagaggaaatacccgatgaaggcacgatttgcgaaattgatggtttgctaatcactattcttgaagtgggcgataatatgataaaacaggcgaaagtcgtcaaactttaatcataaaaaactccaccaaattgaaccgcacttttgacttggatcataagtgcggttctttttttgcgcattttttagaaaagatttttataattctttctaggtatattttgatagaaaagaaagatatggaacacgaatatcaacgggcggtgactcgcgtgtgcgtacaaacggcactgctcttgttacaacatggggcagaaagtaccgtggtggtacaaatggcacagcgtttaggcgtagcacttggcgtagaaagtgtagaatgtgcgcttacggcaaatgcagttgtgctgacgaccttatcagataatcattgcattactaccgcacgaaaaaatacagataaaggcattaatatgcaaatggttactgatgttcaacgcattgtgattgccgttgagcatcatttgtatgagttagagatcgcacaaagaaaactggatcaattaaaaccgcttaaatataaccgatggttagttgtattcatgattggcttatcttgtgcagcattcgcccatttatctagtggcgattggataatttgcggcatcacaatatttatgttgaaattactctatgatatgctatttgctgcgattccagcggtgggctttgctttagtatttaatgtaccgcccaaagccttaaaatattgtgcaattttagccgcacttgggcatgttacacgcacattattactgcatattaatatgcctattgtatttgctacattctttgccacttgcgtgattggatttttaggcgtgcatctttcccatcgttatttagcccatcccaaagccttcaccgttgccgcaattatccccatgatccccggtgttcatgcttataaagcaatgatttcaatggtacaaattcatcattttggcttttctgatgctttatttgaacagatgattagctcctttattaataccagttttatcctaggcgcaatagtatttggattggctttaccaggcttattgttttatcgacaaaaacctgtggtgtaacactaaaaacagtgcaacaaaaaagccgacatttgtcggtttctactattcttgtgattttttcttgaggtattcataaagctcatctttaatccgtaattttccttttttcaaataacgatttccattttgtaatcaattcattatttaatgtttggcgcacttgattattcacataacgaatgtattccacaaaaagttgatccacttcttcacgatcaaaagaggatagaattaattgattaagattattttcttgagaaaacttaaaatgtgaggcaatttgctgaacagtttcattttcaactttagctctcgctttcacaaaatcagattgatttaaaaaagccattaattgagcggatgaagtaagaatttttgtaaattcatgatacgcagaatctgtcgccttacgctcaatttttaccatatcaacggcatcagcatcaccactaactaaatggggcgtggattctaatacaaagtgcggtcaattttnctttatttttatacgttggcttttaaactggtttatttgaagaaagcacgctagaataaggttgttttcatttcaacgaaaaaagtaaggaaattctatgatcgatccaaatttactccgtaataatttagcagaagtcgcagaaaaattaaaagtaaaacgcaactttatgcttgatacggaaaaactcaccgcgttagaagatcagcgcaaaaacttacaagtcactaccgaaaacttacaagcggaacgtaatgctcgttccaaagccattggtgctgctaaagcgcgtggtgaagatatcgcaccattattggcagaaatggatgatatgggcaatcaattgactgaagcaaaagcacaattagatgcggtacttgcagaaatcaatcaaattgcattaagtattccaaatctacccgcagacgaagtgccattaggcaaagatgacacagaaaataaagaaatcttacgttggggtacaccgcgtacatttgattttgaagtgaaagatcatatcactttgggtgaagaagcaaatggcttagattttgctgctggggctaaattagctggtgcacgttttgccgtaatgaaaggtcaaatcgctaaaatgcaccgtgcattggcacaattcatgttagatcttcatacggaacaacacggctatttagaaacctatgtgccttatttagtaaatcacgccacactttatggaacagggcaattaccaaaattcggggaagatttattccatactttagccttagaaggcgaacaaccttacgcattaattccaactgcagaagtgcccgtcactaatttagtgcgtgacgtgattattgatgaagcagaattaccaataaaaatgaccgcacatacgccatgtttccgttctgaagcaggttcttacggtcgtgatactcgtggtttaattcgtatgcaccaatttgataaagtagaaatggtacaaatcgttgatccagataaatcaatggaagcacttgaagaattaacaggtcatgcggaaaaagtattgcaattattaaatttaccataccgtaaagttttactttgcacaggcgatatgggctttggttcttgcaaaacttacgatttagaagtttgggtgcctgcacaaaatacttatcgagaaatttcttcttgctcaaatatgtgggatttccaagctcgccgtatgcaagcacgttgtaaagcaaaaggcgataagaaaactcgcttagtgcacacattaaatggttcaggcttagcggttggtcgtactttagtggctgtacttgaaaactatcaaaatgccgatggttcaattaccgtgccagaagagctacgtccatatatgggcggattagacgttatcggaaaataatccttctagaagataaaaaagcgtggattttaaaatttccacgcttttttattatcaaagccttacaataactgttttaaattttttggtattcaagccaattaggaactttattctattataaaattatatctataacatagaaaatttatctttcaattgacatcaatatccagaacattactctaaaaaacatatcaaagtatctaaattgttataatattagttcactttacgattaaacaatagtaagaagcaattttaataagttagatattccacgtataaaacagtataattccatcaatagctcataaaccaacaggagtattttatgaaattatatggtttaattggtgcgtgttcatttgttccacatgtggcattagagtgggtaaaaatacgtgaaaatgctgattatgaatttgaacctgtcactcgtgagttaattaaatcacctgaatttttatcattgaatccacgcggggcagtacctgtattagttgatggcgatttagttctttcgcagaaccaagcgattttgcactatttagatgaactttatcctaattcaaaattatttggtagcaaaaccgtacgtgataaagccaaagcagctcgctggttagcattttttaattccgatgtgcataaatcatttgtgcctctgttccgtttgccaaactatgcaaaagataacgaaacacttgcacacactattcgccaacaagcagtagagcaaattttagatcaacttgcagtcgcaaatgagcatttagaaagtcacatttattttggagaaaatatttccgttgcagatgcctatctttacattatgctaaactggtgcaaagcagtcaaaattgatttcagccacttaacacaactttcggcttttatgcaacgtgttgagactgatcaagctgtcgaaaatgtgagaaaaagtgaagaactaaaagtataaacaggaagtttctacaaaaattgcccgtttttaaccgtttgtatcacgttaagtttaaatttaagtgagtaatttcgcgtcttacccaacacagctaacccattgattctactatgattaaactggttaatccaatgtcgcaatgttctactgtcaagttgaaaatgtttactgatgagtgaataatttttaccattttgaatataaaattcgatgacttgttgtttgaaaagagtgttgtatttggctataaaaaatctgcntcttacaattaatttatataagtaaaaatatcttgcttttatcatcgttaaacttagaataaatataaataattatcattaagatttaagggtatatatgaatattttaattaataaacgtatctttttattagttacccttgtaggtattcaactaaatgtaaccgcaaaacnaaattcttctaattctaatagagaggagttattacctattattgtgaacactaatgatgatagtaataaactacctggtcgttcagtattaaaacagaaaaatatcgaacaacnacaagcggataatgcagcaaatttaattaatatcttgccaggtgtgaatatggctggcgggtttcgccctggtgggcaaacattaaatattaatggaatgggtgatgctgaagatgttagagtgcagttagatggggctacaaaaagttttgaaaaataccaacagggttctatttttattgagcctgaattattaagaagagtaacagtagacaaaggaaattattctcctcaatatggtaatggtggttttgctggaacagtaaaatttgaaactaaggatgctagggatttcttgcaagaaaaccagaaaataggtggttttttaaagtatggaaataatagcaataataaccaaaaaacttatagtactgcactagttttacaaaatgaacaaaaaaatattgatttattactatttggttctgtaagaaatgctggcgattataaaagacccgataatagcaaaattcttttttcaaaaaataatcaaaaaaccggattaataaaattaaattggcaaatttcacccgagcatttactcacattatcgagtgtttatggtattcataaaggctgggagcctttcgcagcgaaaagagatatcctacctaaaccaagtttgagtgatataatgcgttatggtactgatatagcgtggaaacgtaaactggtttatcgagatcaaaaagatgaaaattacacattaaaatacaactatctacctgaaaataacccatggattaacttatctactcagttcagctacagtaaaaccacacaaaatgatatgcgtcccaaagaagcatcttcaggattagtgggtagcttaggtaatcaaagctggataacttattcagatcttacttttgatataaataacacaagtacttttaatatcaaaactactgttcatgaactattatttggtttgcaatggttaaaaaacacaagaaatactttaatgtatgataaaagtaaagtgagaaaagcggattataattatggctatttccaaccctattatatgccatctggacgtcaatatacacaggcgttttatttacaagatcaaataaaatggaagaatataatttttagcacaggagtgcgttatgaccatatcaataatatagggcagaaaaatttagcactaaaatataatgatatctctgcaggacatgattatagccagaaaaattataatggttggtcttattatttaggtttaaattatgatgtaaaccattatttaagtttatttacgaattttagtaaaacttggcgagcacctgttattgatgancagtatgagacgcaatttaagcaatcttctgtgcctgcaacctctttaaatttagaaaaagaaatgattaatcaaacgagagtgggtggaattattactctcaatcatctatttcaggaaaatgatgcttttcaatttagaactacttatttttacaatcgcggcaagaatgaaatatttaaaaccagaggagttaattgtgtaggcaatgctgcagataccaataataaggtttgtcctaaaatcattgaaaattatcgtaatttgccaggttatgttattcaaggtgcagagttagaagcttattatcaatctacttatttatttggtgagataacatattcttatgtaaaaggaaaacgtgacacctcaccaagaaacccatggggtaaaacctcaacatggattgctgaaattccccctagaaaagcaactactgctttaggtttcaatgttccaaaatattatctcacagtaggttggcgtgctgagtttgtaagaagacaagatcgatcgccattatctggtgatcctaaagcatcatcttggtcattgccagcttcaagaggatacagcctacataacctattcctttcttggagccctgcaaaaattaaaggtatgaatgttaagattacagtggataatttattcaatcgagcatacaacccttatctaggcgaattggcttctggaacaggtaggaatatcaaatttagcctatctcagaaattttagaataaatagcccgattgaatctaatcgggctttatcataactataattagatcataaaaaaatgtagagataataaatataattncctatactaattttagtattctttaaagagcaaatttaaataataaatccaaataagtacgacatcttaaattatagataaatatcaaaattatgttttatctttaccctattactttccataatagaaactaaacttacctaaaaatttaaatataatttagcatctngcttaacaacaaagtcaatacacatttcttctagttttcctttctttccgattaatataccccaaactatatagcctgttgttctcactaactttcctactataggaatatcattagcataagctatgaagaagaaagttaaaacagaggcattatgtaatataagttatttatataatttaacataactttccatataacaacaacgcatctttataacataattgcaatgtattctgttttaaatttatagcaattacctaaatagtaaagagtacgaataaagtacatataggctattaattactttaaaaaaaattaaaatatatttgtagatttatggacaattacatttatcctttaaaaggtagttaatctagagaaattttttatagcaatacaacaagtttacaaggaattcaaatatttttaatttttagaaaaaaacaaaaaccctagcttttcaactagggttctgtttttatgtgatttagatttgtatctgataacctggcggtgccctactctcacatggggaaaccccacactaccatcggcattacagcgtttcacttctgagttcggtatggtctcaggtgggtccaccgcactatcgccgccaggataattctttgataactcgtcttttctcttttatctctcgtctcttttatctctcgttactcagtctttcctcttacctttcactcgttcttattggtcacaagctgaatccgattttctttctattaagtcttctatatttacttttctttgtttagtcttttacttctctttcgctctgcttttatttgcttcgcttttcatctcttacttcacttagctcccaaaaacacttgagcgttgtatagttaagcctctcgggcaattagtattggttagctcaatgactcacatcacttacacacccaacctatctacgtcgtagtctacaacaacccttactgacttaaagtcagggatgactcatctcttggcaagtttcgtgcttagatgctttcagcacttatctcttccgcatttagctacccggcaatgcgtctggcgacacaaccggaacaccagtgatgcgtccactccggtcctctcgtactaggagcagccccaatcaatcatcctacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctctttcgatgacaccatcaattaaccttccagcaccgggcaggcatcacaccctatacgtccactttcgtgtttgcagagtgctgtgtttttaataaacagttgcagccagctggtatcttcgaccggttcaaccttcaggggctagcccttacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagcccacctctcgatgaaccttcttccgcttacacaacgctcccctacccaacagaataaattctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaagccgggatggccccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactattcgcccagttaagactcggtttcccttcggctcccctattcggttaacctcgctacaaaatataagtcgctgacccattatacaaaaggtacgcagtcacaaggttgccctcgctcccactgcttgtacgtacaaggtttcaggttctatttcactcccctcaccggggttcttttcgcctttccttcacagtactggttcactatcggtcaatcaggagtatttagccttggaggatgggccccccttcttcaaacaggatatcacgtgtcccgccctacttctcgttagcttagtaccacaatatggtttttagatacgggattatcaccctctttgattgtgcttcccaacacattctcctcactatattgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtattttcattcaactaaacacttgattgcttttgttcaatcaagatttttttacaaaacaggttttgtttttagagtttccttttcagttctctctttcactttactgttttgcctactcagactttctctcgaaaatctcttgttttcagcttgtttccaattttttaaagaacagtaagacaatctaataaagttatctttaattggcgtccccacggggattcgaaccccggttaccgccgtgaaagggcgatgtcctaggcctctagacgatggggacatcaattaaagatactctattttctttttatcttttaacgtttatttttcaacgttgctttcgcttcgtttttaatcttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcctaggttaagcccagggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtactattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactgcttagctataaataaaatactacttaaaaaagtaataatgaattttcagttaagcacctattaagacttcaaaattaaaaatagttttaaaacaagtcaatcaacaagtgcccacacagattgtctgatatattgttaaagagcaaaataaagtggtcggcgagataggatttgaacctacgacccactggtcccaaaccagttgcgctaccaagctgcgctactcgccgtcagatcttataaagataagatggggtggctaatgggattcgaacccacgacaactggaatcacaatccagggctctaccaactgagctatagccaccattaaaagttgttactgcattgacctggcgcgctcgacaagattcgaacttgcgacctttggctccggaggccaacgctctatccaactgagctacgaacgcgttactgcgtcgttgcggaggcgtatattaatgatttaataaaaccttgtctagcactttttgaaaaaaaatgtttgagcgatagttttttattcagtttgtttaaaatacactattttttcgactatttttacaacttggcgaatcattatatatgtggaatcatccaacaattatgaatttgtttattacgttcaaaatctagcggtaacgttttatgcgaaatttctattgcacttaagcctaattcttccaacgcaactaaattcattttgaatccacgtttattattcgaaaaaacaattgtgccattattcgacaaaactcgttttaaattgcgcattaatttcacatgatctcgttgcacatcccaactctcttccatacgtttagaattcgaaaacgtcggtggatccgcaaatatcaaatcaaattgacgatcacatttttctaaccattgaaggcaatctgcttgaattaatttatgtggtttaccttcaatatcattcaaaataagattttgctccgcccaattaagataagtatttgacatatcaactgtagttgtcgatttagcgccaccaagtgctgcatgaacagtggcagaacctgtataagcaaataagttcaagaaatctttaccctttgccaactcaccaatcatttttcttgttaaacggtgatctaagaataatccagtgtctaaataatctgtcaaatttacccaaagttgcgtgccatattcattcacataaaagtattcgcctttattggctaacttctcatattgatttgtacctttttgtttctgacgaactttgaggatcaacttattcgtttccacacctgtcacttgcaaagttgcagtaacggcatctaacaaacgctgacgagctttattttcatcaatatttttcggcgctgcatactcttgcacaacaatgtaatctgcataacgatcaacagctaaattatattctggcaaatcagcatcatataaacgataagcgtctaattcttgttgctttgcccatttgctaattttcttaatatttttttgtaatcgattagcaaaatcgggggcgacctccgaagtgcggttaaattctagttccttttcatctgtaattgcgtcagattttcgttctgaaacttgataattcttttgcacacaatctagtgggccattttttgctttaaactgtcggctggcacgcattctcaaacaatcaagcaatgtggattcgctactaaaaacagaaacattccaaccgcaaaattcttttttaagtctttgcccaaatacagaatagagcgcgattaaagctggtgttgttcctaaacgttcgccataaggtggattacagataaccgtaccgacttcatttaaacgaggattttttaacgctgccacatcagcttgctgccatttaattaaatgtgaaacacctgcattttgtgcatttttctgcgccttttttaatacgcggtgatcgaggtcaaatccataaaagtgcggttgaatttcacgttgtttttcttctgctaattcaatcgcttcattttttactttttcccaagccgattgattatgcgctttccaaaaatcaaatccccaatgtaaacgataaagttgcggcgcaattttggcttccatttgtgccgcttcaattaaaagcgtacctgaaccacacattggatctactaatggagaacccacttgccaacctgaacgcattaacaattgccgccgcgagagtttcacgtaaaggcgcttgacctgcatcttcacgatagcctcgcaaatgtaatgcttccccacttaaatctaaagaaatcactaaattttcacgattcaaataagcatggatacgtacgtctggctgaattttatctacatcaggacgagttttaccttgacgttcaaagtaatcgacaattccatctttaacgcgcatcgcaccaaattgagtatgacgaatttcttggttggttccattaaaatcgacaaagaatgtcactcgttcatcaaattgtgctaaccaattaaagcctgaaacagccgcataaagatccaaatcactgtaaattttggtttcaatcaaaggaaataaaatgcgtgaagcaaggcgtgaccaaagcaaagtgcggtataaagtttcgtcatcagcttgataatgaacgccaccttgaaccacttttgcctcttgcgcacccagttcagtgagttcaacttttaataattcttcaaagccacgagaagtcgttgcaaataattgtttcatttaggtaccgattttgaaaattttgagggattatagcatagaaaaagatgatctaattgagatcatcatagcgagttaaactgtaaaaagaaaagccctgattttcttaaatcagggctttagaatttgttggttgcgggggccggatttgaaccgacggccttcgggttatgagcccgacgagctaccaagctgctccaccccgcgtctgatggggcgtactatactcgcttaaaattgaattgcaagaattaaacaaaacttgatgtattgtttgttaataaaatgttcaatatgtggttttattaatcaacttcgctaaataacactggttgttttcagtaaattttgatagcgtatgcagccctattgtrgcttactttagaattaaaaaatgtcgatgcttaaacctttctggttcaaaactttttctatctcaattattaccgcacttttggtagcttgtacctctaacacaanaaacactcagattccaaccncctcaaatgggagtgatcctcaacaattcggtgtgcaaaatataccaatcgaacttatcagcaaaccgctcttgtgcctgtttcctatatagaaaaccaaagtgcggtaataaatcaaggcgattttttaacacagctttccaatataaaaaattattcaagtaaactttccacaaatttttacgataattatgaaaagaattacaaattgggttctttctggggcaaatattaatgaactcactcaatttaatatccaaccacaaattatgcgtggctttgatggatttcaaaatgtgctgatgacaggctattattcgcctatactttatgctcgtcattccccacaaggtcaatttaaaaatccaatttatcgtatgcctgtaaaaaaacgtctaagtcgagcacaaatttatgcgggagcattagcggaaaaagattagagttagcatatagcgattcaatgttagaaaactttttacttggtgtacaaggcagtggctatgtagattttggcgatggcaatcttaactattttgcttacgcaggacaaaatggttacccttacacggctatcgggcgtttattagtagaagatggcgaaattccaaaagaaaaaatgtctattcaagcaattcgagaatggggtaatcgtaatccctctcgtatacaaagcttgttagaacgcaatgaagcttatgtattctttaaaaatgatccaagtggcaaagtgaaaggctctgcgggcgttcctcttgtagcaatggcttcagtggcatcagatcgcaatattatcccatctggttctgtgcttttagtcgaagtacccgacattgataataacggaaactggcttggcacacacaaattacacttaatggttgcacttgatgtaggcggtgcagtgaaaggtcatcactttgacttatatcgtggtatcggtgctagagcaggacatattgcagggctttcaaaacactacggtagagtatgggtattacggtaatggctagaatagataattacgaacaacgctttggtggcattggacgactttatacgcctgatagcttagcacgcttacgccaagcgcatatttgcgtaataggcattggtggcgtgggttcttgggtcgtggaggccttagcacgatctggcattggcgaactcacattaattgatatggatgatatttgcgtcacaaatatcaatcgccaacttcctgcgatgagcggcacaatcggcaaattaaaaactgaagtcatgtcagagcgagtaaaattaattaacccagaatgtaccgtcaatattattgatgattttatctcgccagagaatcaatcggattatctcaaccgaggctatgactacgtcattgatgccattgacaatgtgaaaactaaagcgtcgctgattgcttattgtaaacgtaacaaaattaatgtgattactattggcggtgctggcggtcaaactgatccaacccaaattcaaattgccgatctcagtaaaaccattcaagatccgctgctcgccaaagtgcggtcagttttacgcaaggattacaattttagccaaaatccaaagcgtaaatttagtatcgatgcggtattttcaacacaacctttaatattcccacaaatgactgaaggctgttctacttctgccacaatgaattgcgcaaatgggtttggcgcagccacaatgattacggcaacctttggtttttttgccgtttctcgtgtaatagataaattactaaagaaaaaatcttaatcacctcttgaaaatgcacattgaccataaatgtgcattttttattgaatgaaacctattgactttgaaaatgaaaaattttccctctttttactataaaatcgttgcaatttatataaaaaggcgtactcttttttccctttgagaattactaccaacaagtaaggaaacataaatatgaaaaaacttttaaaaattagtgccatttctgccgcacttttaagtgcgccaatgatggcgaatgccgatgtattagcatcagtaaaacctttaggctttattgtttcatctattgcagatggcgtaactggtacacaagtccttgttcctgctggcgcctctccgcatgattacaatttgaaattatctgatattcaaaaagtaaaatctgcagatttagttgtatggattggtgaagacattgattcattcttagacaaaccaattagccaaattgaacgtaaaaaagtgattaccattgccgatcttgcggatgtaaaacctttattaagtaaagctcaccatgagcatttccatgaagatggcgatcatgatcatgaccataagcacgaacacaaacatgatcataaacacgaccatgaccatgatcatgatcataaacacgagcataaacacgaccacgaacatcatgatcacgatcatcacgagggtttaacaacaaactggcacgtttggtattctccagctatcagcaaaattgttgcacaaaaagtagcggataaattaactgcacaattcccagataaaaaagcgttaattgcacaaaatctttcagattttaaccgcactttggcagaacaaagtgaaaaaattacggcacaacttgcaaatgttaaagataaaggtttctacgttttccacgatgcttatggttatttcaacgatgcttatggtttaaaacaaacgggttactttaccatcaatccattagtggcaccgggtgcaaaaactttagcgcacattaaagaagaaattgatgaacataaagtaaattgcttattcgcagagcctcaatttacgccaaaagtgattgagtctttagcgaaaaatactaaagtcaatgtaggacaactcgacccaattggcgataaagttactttaggtaaaaattcttatgcaacattcttgcaatctactgcagatagctacatggaatgtttagctaaataaacctttctaaaaacaatgaccgcacataaaagtgcggtcatttttttttctaaatttgatatttagttttatctccaatatcaaaatgcaaaggcattcgccatttttgtatcgctaaaactaaaagtaatacgccagaaataatagaaaaaatgcgtagtgcaataagattatttaacacccacgaaaaccacaagcaagccacaaatatcggctgtaaatttagcaaaggcacgcggaaacaaaaatattctttaaaacacaaaccacctaaagtaagtaacgcaccgccaagagccaacgcaggataatgattaatataaaaaagtagtccaatccaagttgcaaattgaaaaagcaatcgaaaagattttaagtaaatgtgtaacgaagaggcacaacaggttgccgcaattaatataaatgtgagtgataaatctggataccaactcactgtaagaacagccaacgccgctatcacaaaaccagttcggtaaataataacagtcagataatctaaaaaatccatcggtgatttaatatgtggatcagccattgtataaatgttcctttttatgaattacaaattaaaaataaatatatcctaaaagtcagaaataaaaagtacagtcaatttaaaaacaggttctaaattaaccgcacttttattatttcagttttagcttatcaagaattttttgatgaatgccaccaaaactgccgttagacatcactaaaatatgatccgtaggttgagcctttgcaacaatcatatccactaatcgatctaaatttgcattccaataagcaggttgtacacattggtttgcaatatctgccacttcccaagaaagttgttcaggttgaagcataaacacggcatcagctcgaccaagtgcaggcgcgatgtcatctttatgaacacccattttcattgtgttagaacgaggttcaagcactgcaagaatacgaacaccaccaccaactttatctcgtaaagcggttagcgtagcaagaatagcttctggatgatgcgcaaaatcatcataaaccgtaatgctattaacttcgcctttcacttctaaacgacgtttagcattcacaaaagatcccaacgctttgcacgcatcttcaatagcaacgccagtatgatgagcggcagctattgccattaacgcattatgcatattatgttgtcccactacattccattttacttctgccactttttctccatgatggaaaaccgcaaaatgtgaagcatcatttgtaatacgttcagcaaaccactcgttatctttgcctaaaaattgctgttgagaccaacatcccaatgccaaagtttcttttgcactttgttcactcgccgaacttaataccaagccactggctgggatagttcgaatcatatgatgaaattggcgttggatcgctttgagatcatcaaaaatatcagcgtgatcaaaactaatattgtttacgataagtgtacgtggattgtaatggacaaatttcgaacgtttatcaaagaaagctgtatcatattcatcagcttcaataataaaataagggctatctcctaaacgagctgaaatgccaaaattacccgcaattccgccgattaaaaaacctgattttaagccattttgttctaagacccacgttagcatacctgtggtcgttgtttttccatgcgtacctgaaaccgccaatacccaacgatcgcgcaataaatgatcatgtaaccattgagggccagatgtgtatttcaaattattttccaacacatattctacgcaaggattaccacgtttcatcgcattaccaacaattaccatatcaggcgcaggttgtaattgtgcaacatcataatttggaataatctcgataccttgctcttctaaaaaagtgctcattggagggtaaacattagtatcggaacccgttacgtgatagcccatttgtttagcaatcatcgccacaccgcccataaatgtgccacaaatacctaagatatgaatatgtttcattgtatttctctgttgattaaggaaaacgaaaaatatgataaaacaacttctatgaactttcaaaagaaaagaccatcataccaaactatatgatctataattaacgccactgaactattatttaaccacttcaataggaataaacaatgaaatttaagcgataaagcaatttcagaagcacaatggctcactatttacaaagaaaataatcagccgttctatgtagcaaatcttcctgcattacaatttggaaaaagtattcaagtcgatattattgggacttcaattcattttgctgacggtacccaaattggtttagtttcagaacaaaaataatcctataaaaaatgcctgtgtaaaacaggcatttttttatccgcacttttaagcaattcgctcaaaaccagctttcaaatctgcaattagttcatccacattttcaaaaccaatatgcacacgaattaatgaacctgtaagattacgtttaatatttggacgaatatgtgcaatttcttctggttgattacaaagaattagagactcaaatcctccccatgaataagccatagcgaacagttgaaaatgatccataaattttgatacttgctctgaagttaatcgctgggttaattcaaaagaaaataaaccactgcttccactaaaatcacgtaaaaagaattcatgaccagggcaacttggtaaagctggatggtacacagtttttacttctggttgctcactcaaccattttgccactttaatactgctttcctgatgttgttttaatcgtacccccaatgtacggataccacgagcagtcgtataagcggaatctgcatcaaccatttgccccattaaataggaatgttctctaagttgatcccaagttcgcgcattcgcaacggcagtaccaatcataatatctgaatgacccactaaatatttcgtacccgcctgaatagaaatatcaatatcatgctctaacgctttaaatagaacacctgccgaccaagtattatcaatcataatcacaatattagggttcacctttcttgcagccttcacaatagtcggaatatcgggaatttccattgtaatagaactcggtgcttctaagaaaagtacttttgtattcggttgaataagcgttgcaatatcttcaccaataagaggatcgtaataagttatatcgatctgcatttttttcagcacaatattacagaaatattgggttggctcgtaagctgcgccactcattagcacatgatcgccagttttaacaaaagaaagaatcgaattagttactgctgctgtaccacaaggataaagataacaacctgcccccccctccatttcgcacattaaatcttgtaaagcaaaatgtgttagcgtccctcttctgccataaaataattcgccttttgctctacgttgagtagcgtgttttttatcttcaatactgtcaaatagtaatgaagaagctcgctgtaaaacagggtttaccgatccttgtgaaaaacgtttttgacgaccagaatgaataaacattgttgaaagatcatattttgtttgcatatatttccttatttaaattaacttatagggcaaaaataactatggtttcaattcctatccgcacctgattttacttcatctgcggtattaggcaatggaaaaaataaagagaaaacaacaaataattctgacgtctacacagaatccctaaaatagatgctaacgagctttaattttatcaattatttataaaaagcgaccttaggtggctttttttatcatcagagataatttagaataaaccatctttagctaaagtgcggtcaatttttctatgaaattcaatatcccaattttcctaacgatctttcgagtcattttgattccttttttcgtgattgcattttatttacccattgaatcatctcctttcatcacaacgctcattttttttattgcaggtgtcactgactggctagatggctatctagctcgtaaatggaaacagaccacgcgctttggtgcatttcttgatcctgttgctgataaagtaatggtagtggctgcactagttttaattgtcgaacatcaacatacattttggataaccattcctgccattattatgatttctcgtgaaattatcatctccgcattacgtgaatggatggcagagcttggggaacgtagcaaaatcgcagtctcttggtggggaaaatggaaaaccacagcgcaaatgttagcactaggcggattattatggcgttataacaactatatggaaatagcagcaattatcttactttatatcgccgctattttaactatatggtcaatgatccaatatttacaagtagcaaaaggaagcttgctagataatattcaattataaatttaaataaaacacagttattttttatgataaccatctatatttgagttatttttaatcaaataaaatattttttatttttttcgtttgacagcaatatataaatccgtaaaatacgccccgttgtcacgcagtagtgctgattagtgataaatgcgggaatagctcagttggtagagcacgaccttgccaaggtcggggtcgcgagttcgagcctcgtttcccgctccaatttgcccgagtggtggaatcggtagacacaagggatttaaaatccctcgcctttcgaggcgtgccagttcaagtctggcttcgggcaccatttaaacaccaattcaaagattttaaaatttattttaaaatcatctaattgggtcgttagctcagtcggtagagcagcggacttttaatccgttggtcgaaggttcgaatccttcacgacccaccacttaaaaataaagtaagcaccgaaaggtgtttttttattatctaaatctctgaaactcatataaaaaatccccgactcaaagaatcagggacttttacaatcaaacgtctttaattaattaacgctcattccaacgtttaatagactcacgaatcacttctttcgcttcttctacatcgccccaatgagttactttcgttgagccaggtttcttaagcgctttatagttattgaaatggaactcaatttgtttaattaagtttgccggtaaatctgctaatgaattgtaagcatttcctgtatcacgatcatctgcaggaacacaaacgattttatcatccacttcgccatcatcaacaaatttcatgacaccaattactttagcctcaaggaatacacctgttgctaatggttggcgagtgattaataacacatctaactcatcgccatcttcatctaaagtttgtggaatgaaaccatagttagttggttttgcaaaaattgctggctcaacacgatctaactggaatgccgcaactttacggttccattcgattttatggcagctaccttctggaatttcatttactacattgataatgccagcatctacatcgcctggcgttaaaatttgattaaaatcagccattttgtttccttcattttatcaagttaaaaaacgcaacaagtatagcagnttttctgcgaactcgcagtctcatttgtagagaaaatcagcaaatagatccatctcataactattcataattttgaccgcactttatcctaaataaaactcacgcaaacgtttacttatcgtttttatgatgtaaaatagcgcaccttattacttccaattttttacttaacttcaaggaacactatgccaactttagaaaaaacatttgagctcaaacaacgtggttcaactgttcgtcaagaaattatcgcgggtttaaccactttcttagcaatggtttattctgtcatcgtggtacccaatatgcttggtgctgcaggtttccctgcggaatctgtctttattgccacctgtttagttgcaggattaggctctatcttaatcggcttatgggcaaatgcaccaatggcaattggttgtgcaatttctcttactgcttttacagcatttagcttagtgattggtcaaaaggtcgccattcccgtngcgctaggcgcagtattcttaatgggggttgtgtttaccttaatttctaccacaggtatccgtgcatggatcttgcgtaatttaccatccaatatcgctcatggagcaggcattggtatcggactctttttacttttaattgccgcaaacggtgttggtttagtcgtcagcaaccaagctggcttaccagtaaaattaggcgatttcacctcattcccagtcatgatgtccttaattggcttagcgttaattattggccttgaaaaaatgaaaattaaaggcggcattttatgggtaattatcgctattactatcgtaggtttaatttttgatccaaatgtaaaatttggcggagagattttcaaaatgccaacctttggtgaaaattctcttttcttacaattagactttatgggcgcactacaacccgcaatcttgcctgtggtatttgctttggtgatgactgccgtatttgatgcaaccggtacaattcgtgcagttgcaggtcaagcagacttgcttgataaagatggtcaaattatcaatggcggtaaagccttaacttcagattcaatcagtagcttattctcaggcttattcggtacagcaccagctgccgtttatattgagtcagcagcagggacagcagcaggcggtaaaacaggtattactgctatcgttgttggtgtgttattcctattaatgcttttcttccaaccattagctttcttagtgccaggctacgcaactgctccagcattaatgtatgttggtttattaatgttaagcaatgtaagcaaattagatttcgatgatttcgttggcgcgatgagcggattaatctgcgcagtgtttatcgtacttaccgcgaacatcgtaacaggcattatgttaggttttgcggcattagtaattggaagaatcgtgagtggcgatattaaacgcttaaatgtaggtactgtgattattgcaatcgtacttgttgcattctatgcaggcggttgggcgatttagtaacagaaataagaaaagggaaaagccttcccctcaattttaatcacaaaagtgcggtgaaattttaccgcacttttttatacttggattactctttcttcaataagaaaataccgtggatcagataaatttacataagcttgttttaaaattggcattaaaatccctctggtttacaatttaccagtaaatctttgccccgcccagtttgcaaccacttccccaatggttgccccatataaaccgcacttttaatctcgcaacgttgtgcatcgctaccctctgcagcaagataaattgcttctgggcgaatacccactaaacattcgccatcgggtaaattaaactgtgcagcatcttttaaaggcacagagtaaccattaatatccgccacgccattttctaattttccatcgaaaatactggattcgcccataaagttagccaaaaacagagaatttggtcggagataaagctctttcgccggcgctttttgcataattttacctttattcatcacaatcacttcatcagataccgcaaatgcctctgtttgatcgtgtgtcacataaagcgaagtaatgcctaaacgttgttgcaattcacggattttttcacgcatagaacgacgtaagtttgcatctaaattacttaatggttcatcaaacaataggacttttggtttcaataccaaagcacgagccaatgcgacacgttgttgttgcccaccagaaatttgatccacgaaacgatcttcaaagcccgctaaatccactaattctaaagcctcttttacacgctgagcgcgttcttctttgccaatgccttgcatttttaagccgtagcccacgttatcgccaatgctcatatgcgggaaaagcgcgtaagattggaaaacaatacaaatatctcgattctgaatagaggattttgttacatcttcgccatcaataaatatttgacctgatgttggattttctaatcctgccactaaacgtaatacggtggttttaccacagcctgatggccctaacaatgttaccattgtgccacgtttgatcgttaaatctaaattatcaatgacgaccgctttaccaaatgcttttgtgatattttttaatactaagaaatcattattactcataatttttacctacaacttaacgagttaattcatttttttcgctttagaacgggaaatacgcgtatcgcctacaatccagtcgaaaaacaaaataattgccatcatcacaacaattaaaatagaaccgtatgcaatcgcaatgccgtattctccgtcttccacacgatttaaaatatatgcggtagacgcgagtntctgctgtcactaagaatataatcgcacttaccgtcgtcattgcacgaacgaaactagtcactaaagcagaaagcaacgcaggttttaataatggcaatacgataaagcacaatgttttccacgaactcccttttaaagaaagcgatgcttcatcaagggatttatcaagctgtcctaacccagcaatcgctgctcgcataccaatgggtaaatcacgcattaccattgaaataatcacgataatgcccgtacccgtaatataaagcggtgcattgttgaaggctaaaatgtaagacaccccagccacagtacctggcacggcaaaacaaagcatagttaagaactcaagggattttttaccttggaaatctttacgcaccacaatatacgcaatcaataatccaaagaatgcagttaatggcgcagcaatacccgcatagattaaggtattgattagtgacggccacgctccatcgctcaatccttgcccgaataacatggcatagtttttcaaggttaaagtgtaatttacgccccagtttacagtgaaacttccgtagaaaatactaccgtaaagtgccatattaaagattacccagaagccaagcataccgatgatggtatatttcaagccatttggcagctcttgcacatcgccacgataagatttccccgaaacagtgacataagagcggttaccaatccaaatgtattgaatgataaaaatcgccaacgagaaaattaacaacatcgaacccaaagtactggctgaagcataatcaagttgtgaacccgcaatatagaaataaatttgtgtggcaatcacatcgaaacttccacctaacactaaaggattactaaagtccgccaatgattgaatgaatacaattaagaaagaatttgctaatgctggacgcagtaacggaaaaataatctgatagaacgtttgataacgattagcacgcaacgtataagacgcttcttcaatagacgggtgtacggattttaatgcgccatctaaaatcataaaagaaataggagcaaatgcgagaatttgagcaatcgcaatcccattaaaaccataaagccaattatgactagaaaaaccaaaattcgtacttaaaaattcggttacataaccagaacgtccgagcattaaagtaaccccaagtcctacaacaaatgggggcgtcacaattggcaaaatagagaaaatttttccgataaatgccgttctacgagcgatacgcgtggtatagagcgcaaaggctaaaccaaatacagtagaaacgatgcccacaaagcccgataagaaaagcgaattggtaattacgcggacaatatagctctgcgttaaaattcgcatcacttgttgtggcgcaaaggtatcgccgtcataaaacattgaaacgaaaatcgccaatgttggataaacgataaagaagaaaatgagcaagataatgcaaagcaaagaagcgatgataaatttatcaccttgcatcacttttagttttgccaatgaaagtgtcgccaatgcggtatatcccacaagtaacacaatcacagaatagcccatactaattttgtacaccgtcgcactgataaacataaacagtacagaaagtgcggtcaaaaatagctctgtttttgcttgggtttgctgtggcaatctcaataacggcaaagcaccatacacaattacaggcaggaaccaagcccaagttaaattgaaagaagcccagcccattgcctctaaatattatctgaagtactttcaaacaaaccgtaatcaagtgcattggaaggcagaagtgcaaacgctaacaaggataaaataatccaaaaataagcagaatgcattatggaaagtttttttgcgttcatacaacctcgcagtaaagaaaacctgactttcgcctagggtaagtaggccctaggataattacagtaactcccctattggggagtaaaaagctgtcccaaaggggaactactattacgataattagccgtgggtatacttactcacggctatgattgtcacgaaaactatttcgccaatttaacttcttgaacccatttttcaattaaggctttgcgttgttctgttgcaccgtatttttcaaagtcataattgattaatttgagtttatttggatcaaatgcagttggcgattgttctgcggtcgtgttagttaagatttgtaaagaatccccttgtttccaagctaattcttgaccttcttttgataaagcccaatcgacgaataattttgcattatcaatattacgcgcaccttttaaganactcacgccacctaattcatagcccgttccttcgcacggcacaactaattctaatggcgcaccattgcgtttttctaaagcataatcgtgtaagaaacccaccccaattgtcnttcgccacgcgcagagttacgtgatggcgtgatacccgatttggtatattgagaaacattaggatgtaactcttttaggaaatcgaatgcctctttttcgccccataattgaacgaaagttgccaatgcagtgtaagcagtacccgcactttgagggtctgcaatttgaacttcaccttttaagcgtggatcggttaagtctttccagcattttggcacttctttaatacctaattttgccaaacgttcagtattcacaccgaaacctaagatccccatataaattgaggaaacataatggcctttcgttttcgctggttcacggaaacgttctacaatttcatcaatatgtttggatttataaggctcaattaaccctaattctgccgcttgagcttgagggtcaaaagtaccgccgaaccaaacatccgcttgagggttatttttttcagcttcaactttagcaaaagtactgcctgaaccattacgaataaaggatgttttcacatcatatttttcgccaaatgctttcgtggtggtttcgcacaaaatattggttgcactacaatatacaactaaacgacctttagcgttagcagaaccagaaacagccaagccagcagctaaaagtgcggtagaaacagaaagagaaattttgttgaatttcataatacatactccttattggataaaatgtttgaatcctacttgaaaaatagaaataataccgtgatgaagttcacagtttttaaaattcaagtgaaaaaatanacgtgaaattcaccgcacttttctttataattgcaagaattttccttacatcgaaacacgattatgtcaaatccctcttgtatcatcatcgccatcacaggtgcatctgcatcaggcaaaagttctatcgcttccactgttcacaaagagctctgtaatgaactaggctgccaagaaattggtatcattactgaagacagttactataaagatcaaagtcatttagaaatgactgagcgggtaaaaacgaattacgatcatccaaactctatggatcgcgatttacttatccaacatttaaaaaatctaaaaaatggcagtgcagtagatgtgcctgtttatagctatgtagaacatactcgcaccaacgaaacaacgcatttcacaccaaaacgaatcgtaattttagaagggattttattacttaccgatgaacgagtacgccaattagccgatatttctgtattcgtagacacaccacttgatatttgtttcatccgccgtttacaacgtgatatggaagaacgtggtcgctctctacaatcagtgattgatcaatatcgtgcaaccgtgcgtccaatgttcttacaatttattgagccgtctaaacaatatgcggatattgtcattcctcgtggtggtaaaaatcgcattgcgatcaatatgttaaaagctcaaatccttcatttattgaatcaaaaataggaaatcttatgcgtctttgcgatactgatattgaacgctatcttgatgatggcattatttctttaacaccacgtccaaataatgacaaaatcaacggtgcgacaattgatgttcgcttggggaattctttccgtgtatttcgtgaacactctgcaccttttattgatctaagcggcccgaaagaagaagtatccgcccagcttgaatcagtaatgagcgatgaaattattattccagagggggaagcatttttcttacatcctggtactttagccttagcaaccacgcttgaatccgtgaaattgccagccaatattatcggttggttagatggccgttcttctttagcccgtttaggcttaatggtacacgtcaccgcacaccgtattgatccaggttgggaaggaaaaatcgtgctggaattttataattcagggaaattaccattagcattacgcccaaatatggtaattggtgcgttaagttttgaagtattaagtggcgaassaaaacgaccatacagtagccgcaaagatgcaaaatataaaantcaacaaagtgcagtagccagtcgtattgacgaagacaaggaataatcgatgaaaaagttcgcacttatcgtagggatcgtcgctttggcgatcttttcttttttatatattcaactttaccgcgtgcaaagtgctattaatgmacaactggcacaacaaaacattgccgttcagtcaatcaatttatcattattttctcccgcactttcccttgaaaatataaaaactacgcaattttcagctcaaaaaattgaagctaaatttagttttttgcctcttttgtatggaaacgcagcacttcattcactgaatattcaacagctcaaattaactcaaaacacacaaaatcctgccaatgtatcgatagagatttcgcctttttcattaaaacagcttttatcaaaaaaagtaatattaaatggcgaaaaccatattcgcattgaatttaataaacctatttatggaaaaacaaaaactttccatttttctttccataaagcgaatttagacttctcaacatcagaatcaaccccacttcaatttgtagatgcaagcctaaataatcagcctatcggttatattgaaactcacacagcccaccaacaaatagtgacttatataaaaccacaatgcgataacgattgtttagccgtattgaaatatcaacaaatagacaatcaaagtgcggtaaatttttcgggtaaatatttccctgttcaacgcttattcgcactattaaatttgccagaaatgttaagtggacacgccgattttgatcttgatttcagcttttcatcttcctcgcttattcaaggaaaattaaattttttagcgcaaaatggcgaaattcttggtgtgaatttattggatatggtagcgcaatatttcccgattaattacaacaatgatttgttacaaaacaaagaattaaacactcgctttgaacaattttacttacaattatttctccaacaaaatcaactcattgctgaaaaaatcgaattaaaaacgcccgcacttttggggcaaggaaaaggcatcattgatttaaatcgaatggaatgcaatgtggatattaatttaaattctacggatcaacgctatcaaaatttgacacttccaatcaatttttttggtaactgcaattctccacaatacaaaattaattttacgaagaaattccgccatcaattaattgatgcgattaaagaaaagttacgttaatgtcgttatatttaaaagctgaaaaaatccaatcatggcgcgtgcttattatggcttgcgcaggatttatttttaatactacagaatttgtacccgttgcaatgttaagcgatattgcacaaagttttgatatgcaaaccgccgatactggtttaatgatgacagtttatgcttggacggtgctaattatgtctttgcctgcgatgcttgccacgggcaatatggaacgtaaaagtctgcttattaagcttttcattatatttattgttgggcatattttatcggtcattgcatggaatttctggatattacttctcgctcgaatgtgtattgcattagcacattcggtgttttggtcaattactgcctcacttgtgatgcgcatctcacctaaacacaagaaaactcaagcattaggaatgctcgctattggcaccgcacttgccacaatcttaggcttaccgattggacgaattgtcggacagctcgtcggttggcgggtcacttttggcattattgcggtactggcattatccatcatgtttttaattattcgattattgccaaatttacccagtaaaaatgctggctctattgcaagtttacccttgcttgctaaacgtccattattactttggctttacgtaacaacggcaatcgtcatttcagcacactttactgcttatacttatatcgaaccatttatgattgatgtagggcatttagatccaaattttgccacggctgtattattagtttttggtttctcaggcattgcagcaagcctattatttaacagattataccgatttgctcccacaaaatttattgttgtttcgatgagtttattgatgttctccctcttgctactcctcttttcgaccaaaacaataatagcaatgttcagccttgtgtttatttgggggattggcatttcttgtatcggactatctctacaaatgcgcgtactaaaacttgcgccagatgcaaccgatgttgccacagctatttactcgggcattttcaatgcaggaattggcgcaggcgcattatttggaaaccttgcgacaacctatttaggattaaatgaaattggttatacaggcgcagcattaggtttaatcggtttcatcatttttattacaacgcacttaaaatatcgccatacatttcttctgcaaaacaaataaaaaaataaccgcactttagttctccaaaaagagttttaaaagtgcggttaaatcttgctaagttttatttatcttgcgtttaacgtttcgctttcttaataaatttcatcaaacgtttacgtttacgcaattggttcggagtgagtttatttttgcgtcctgcaaatgggtttgagccttcttggaaaagcagacgaatcggtgaaccaataatttttaagctcttacgataataattagataaataacgtttataagaatctggtagtttatccatttggttaccgtgaaccactataatcggcggattataaccacctgggtgagcatattttaatttaatgcgacgaccgccaatcatcggcggttggtgctcatccgttgccatttgcaaaatacgagttaaaagcgaagtcgtcattttttgagtggcacaagcataggcttctttaatcgaatcaaaaagattacctacaccacttccgtgcaaggctgaaataaaatgcacccgagcaaaatcaataaaatctaaacgacgatcaagttcagatttcacacgatctttcacatcttgatctaaaccatcccatttattcacgacgatcaccaaagaacgccctgcatttaaaataaagccgagcaaagataaatcctgatcagaaatgttctctctcgcatcaatagtcagcaatacaacattagcatcttgaatcgcttgtaaggttttaatcacagagaatttttccactgccaaatgcactttaccacgcttacgcacaccagccgtatcaatcaaggtatattgctgcccatcacgctccattggaatataaatactgtcacgtgtcgtacctggcatatcaaaaaccacgacacgatcttcgcctaaaatacgattggttaaagtagatttacccacatttggacgaccaacaatggcaatcttaatatttttatcttgttcttcttcaagttcttcgtctaacgcatcatcaattaatgccgtatcttcttctgaattcaaaatcgaattcttgttcccattcgtcttgttcttcctcagaagtgcggtcattttcatcggcgttttccattttttccgcaaaaggssgcaagtacttgttccattaattgagtaacaccacggccttgtgaggctgcgatttgctcaatttcccctaaacctaactgataaaattcagcacaatgggaatccgcatcaataccancagttttatttgccaccaccacagtaattttgttttgacgttggcgtaaataattagcaataccaatatcagctgccgttaaacccgctctagcatccacaaggaaaagaacaatatccgcttcatcaatagcaagcaaagattgctccgccattttttcttctacaccctcttccgttccatcaataccgccagtatcaataacaataaaatcatagccagcaatatgtgcgtgaccatattttctatcacgagttaaaccgggaaaatcagcgactaacgcatctctcgtacgagtaaggcgattaaataatgtggattttcccacatttgggcgaccaacaagggcgacgactggagttgccataaaaaatctcttattttgtcaaaaatggcgactattatatcggaagttaaaggattggtaaaaaatcatttcataaagaaaagaaaaagccacaggatacaatcctatggctttctaaatactgtttatttatctacaacttaacgttataataatctcgctttcaaggattcagcttgaaagcgagtgttgcgctttttcgcaacgtttgaagaggataagaaaatgattaagatcattatccttgtcgtactactattattagtgagccagcccgcttactaataacacgacatactagggagtaaccgctccctagttcttcaaatattaaaagtttactttatttttgtcaagatgaataaatttcagatacaaaaaaagcacccttaggtgctatctttatttatctttatttatcttaattggcggaatggacgggactcgaacccgcgaccccctgcgtgacaggcaggtattctaaccagctgaactaccactccgagataagatattaattttaaattggcggaatggacgggactcgaacccgcgaccccctgcgtgacaggcaggtattctaaccagctgaactaccactccgctaagtggtgcgtatcttaatgatgaacacaaatctcgtcaatctttttttattaaattttacttacctgcttaaattccacacgattaatgcacattattattgccaaaacgtttatcccaaaggcaattatttccactttttttattcatcatctttaagaattctaaatgcgcttgtagctcatcattagtaggttgaagtaatttcaaattgtgcgaaaaatctaccgcactttttatttcttccgccgttttttcttgcataacacggataactccagactcaacagattcttcttcatcgaataaatttgtttgccctcccgtcatcatcaaataaacatccgccaagatctcggcatccagtaacgcaccgtgcaaagtacgtttgctattatcaatacctaaacgatcacaaagtgcatccaaattattgcgttttccaggatacatctgacgcgccatttgtagcgtatctgtcaccaaacaaatatcgtcagttttcacattgaggttaagtttacgaaattcataatccataaatccaacgtcaaagggggcattgtgaataagcaattctgcgccattaatataatccaaaaaatcttgggcaacttctttgaattcaggtttatccgctaacatttcatcagtaattccatgaactttaatcgcatcaggatcancggggcgatctggcttaatataaatatganaattattacctgtgtaacgacgatttattaattcaactgcaccaatttcaataatgcagtgtccttcataatgcgcgccaagctgattcatacctgtagtttcagtatctaatacaatttggcgattgggattaatcatttgttcaacctatctctttccattaaaatacttgccattctacacaacaacctttttgttatgccnaaacagattgaaatttttactgatggatcttgcttaggtaatccaggggcgggcggaattggtgccgtattgcgttataaacaacatgaaaaaacactctccaaaggctatttccaaaccaccaataatcgaatggaattacgcgctgtcattgaagcattaaatacattaaaagaaccttgcttgatcacgctttatagtgatagccaatatatgaaaaatggcataaccaaatggatctttaactggaaaaaaaataattggaaagcaagttctggaaagcctgtaaaaaaccaagatttatggatagccttagatgaatccatccaacgtcataaaattaattggcaatgggtaaaaggccatgctggacacagagaaaatgaaatttgcgatgaattagcaaaaaaaggggcagaaaatccgacattggaagatatggggtacatagnagaataatacaactgatataacgtcatatttttcgatacctaaaaatatttaatacttaaacctaaaacagaataaaaaataatcaaattcatttaaaaaatgtgatctcgatcagatttcaagnaaattaaaattttggagtattgacatcaaaaattttttttgtaaagatgcagctcgtccgttttggcgattggacaattctattggagaaaagttcaatcatagatagtaaacaaccataaggnatacaaattatgaaaaaaacacttgcagcattaatcgttggtgcattcgcagcttcagcagcaaacgcagctgttgtttataacaacgaagggactaacgtagaattaggtggtcgtttaagcattatcgcagaacaaagtaatagcactgtagataatcaaaaacagcaacacggtgcattacgcaatcaaggttcacgtttccacattaaagcaactcataacttcggtgatggtttctatgcacaaggttatttagaaactcgttttgttacaaaagcctctgaaaacggttcagataacttcggtgatattacaagcaaatatgcttatgttactttaggaaataaagcattcggtgaagtaaaacttggtcgtgcgaaaactattgctgatggcataacaagcgcagaagataaagaatatggcgttctcaacaatagtgactatattcctactagtggtaataccgttggctatacttttaaaggtattgatggtttagtattaggcgctaattatttattagcacaaaagcgtgagggtgcaaaaaatacaaataagcagcctaatgataaggctggtgaagtacgtataggtgaaatcaataatggaattcaagttggtgcaaaatatgatgcaaacgacatcgttgcaaaaattgcttatggtagaactaactacaaatataacgaagctgacgagcatacacagcaattaaatggtgtattagcaactttaggctatcgttttagtgatttaggcttattagtgtctctagatagtggctatgcaaaaactaaaaactataaaactaaacacgaaaaacgctatttcgtatctccaggtttccaatatgaattaatggaagatactaatgtctatggcaacttcaaatatgancgcacttctgtagatcaaggtgaaaaaacacgtgaacaagcagtattattcggtgtagatcataaacttcacaaacaactattaacctatattgaaggtgcttacgctaganctaaaacaactaatggaggcgtaaaaactgaaaaagaaaaatcagtgggtgtaggtttacgcgtttacttctaatcatttgttagaaatacattattaaaagcaaggcgaatcgaaagattcgcttttttttttgctcaaaatcaagttaaaaaatgattaagttaaaagtgtataaatatttaggctattttataattaataaaaaatctgtgatatatatcacagatttttaaatcaattaactatttaagtgtttactattaattctctttccactttccgtttactactgtgccgattacttggtaatttggcgtaaacacggctaagtttgctatcttacctttttctaccgaacctaaacgatcatctataccaattgctcgtgcaggataaaggttactcattctaatggcttccgcaagaggaatttcgacatattctaccgcatttttaatggattccatcattgtgattgatgcccctgcaattgtgtcattcgcatcatagcaacgcccttctttgatataaattgtttttcccacaaaggtaaaactttctagttctggcggtgcgcctgcagctgcaatagagtcagtcacaatacaaagtttgtcgcctttgatttttttatcaatgcgaacattgccgtaattgatatgcacaccatcgacgataatgccagtgtaaacatcagaatctaatactgcacccactacgcccatttcacgtccagaactaattggcgacatcgcattatgcaagtgagtcgcaaaagttgcgcctttgtggaatgcggctttagccacttcataagtggcattagaatggcctacagagacaataatgcccgctttcacaaaatcaggcgtatagttaatggttgggttttctgcggcaatggtcatttttgtaatcacatcaccattttcgcagagaaaatctttcatttcaggcgtaatttcacgaatatattcgggacggtgtacgccttttttctcaatgctgagataaggtccttcaatatgtaaaccaagtgcttggtttttatgcttgtttaaatattcacgcataatttttaccgcactttttatattttcatcaggcgcggtaataaaagtgggaaggaaacttgtacaacctgattttaagttagtttcctgcataatttccaaggtttcaacgctagtttggtcgttaaacatcacgccaccacagccatttaattgcagatcaataaaaccagccgttaaattattaccttgtaaatcaatggttttgatacctgtttctaattcagcttgggggatcactgcttcaataatttcaccgttaataattacagcaaaatcacgtaaaacatcatattttgtgtaaattacacaattaattaatgcgtatttcatattctgttcctaatatcaacatcagtttaacatagcaactatattgctcttaaacgtaaggacaatttgccctatgattgtttgtgattatagggcgaatgtaattcgcccctacataaagatgaagaatagatctctatttatcctgataatccgtaccagcaaccgcgccttctaattcagtaaaatatttcacggttttcacttttagctcttgttgagattatagggcgaatgtaattcgcccctacataaagatgaagaatagatctctatttatcctgataatccgtaccagcaactgcgccttctaattcagtaaaatatttcacggttttcacttttaactcttgttgagcagcttcatcacaaacaagcaagaaatgacggtgcatttgtaatgcactgactgtccataaatggttaatactgccttcaactgcagcttgcactgccagtgctttttgatgtcctgttgctaaaatcatcacttcttctgcatctaataatgtgccaacaccaatggttaaagcatatttcggcacttgagtaacatcattattaaagaagcgtgaatttgcaatcaatgtatcttgcgttagcgttttaatacgggtgcgagaacttaatgaagaagcaggttcattaaatgcgatatgtccatctacgccaaccccccccataaacagatgaattttgccgtaggatttaattttttcttcataacgacggcattctgcattatggtcatcggtattgccgttaagaatattgatattttcaggtaaaatatcgatatgattgaaaaaattgttatacataaagctgtggtaactttcagggtgttcctctggtaaagccacatattcatccatattgaaagtcactacgtgtttgaaactcactttgcctgcttgataaagtcgaatcagttcttgataagtttttagtggtgtgccaccagtaggtaaccccaatacaaaaggacgctcggcggtaggtttaaaatcgttgatacgattgatgatatgttgtgcagcccaacaactgacttgttgttctgtttgtaatggaataaaacgcatattagccttcctttattattgaccgtgatgatcctattcatatcgtaggctggactttagcccaccctacaccaaaggatcattataagtgcggcaattttctatcttgtttttaaaaagaaattcttttgctccaataatttacgacagagcaatagaagttgcccccttccgcccttcgggcaccttcccccgtaaacaggggaaggaaagtgcttgctgacttgctgttctgtttgtaacggaataaaacagggggaggtaagttttttctaatttaaatatttatgacaaaaatttcgctttcaagtcttttgcttttgcaagctgttcttctgttgcttttgatgtcattggttcacggcaataacctgcatccaccccttctaatttaagcaattctttgatggttaaatataaaccgttcgctaaaatgccttcgattaaatcgttggttacgtgttggatttctaacgcttcggctaatttacccgctttggttaattcaaaaatttgacgagcacgaacgccgtttacgttaaaggttgaaccaattgcaccatctaccccaagtgatgctgcaggtaacatcatttcatcgaaacctgcccaaattaagtggtttggataagcttttttcaaacgttctaataaatagaaatcacctgctgtgaattttacccctaatactttcgggtttttataaagttcaccgaattgttcaatgcccatattcacgccagttaagaacgggatagagtacacaatcatattgttgcctgtttcagcgatgatggtgtcgtaataatgtttaatttcagggaagctaaatttgtaatagaatggcgtcactgcagataagcagtcgtagcctaattctgttgcatatttacctaattccaccgcttcttttaagtttacactacccacttgagcaattagtgcgatttgatcttttgcttcatcttttgcaatgcggaagatttcttttttctcttccgttgaaagcataaagttttcgcctgttgaaccgcccacatataagccatcaactttcattttgtcgatattatggcggataatttggcgtaaacctttttcattaatggtgccatcttcattaaatgacactaataatgcactgaaaataccttttaaatcacgcataagttttctcctattttatacgttgttcaagaattacattgagagttttttgtttagtttgagcggcaatatcttcttcgccctgcactaacaaagcataaattaaatctaatacaaaaagctgtgcaattttggtgccaatagaatcgccttgtaacttgccttgtttattaccatttaccaaaacataatcagcatattctgtcacgggggaacgcaaactatgcgtcaatgccactgttgttgcaccattttgttttgcgattttgatggtatgcgccgtttcagcagaataaccagaatggcttaaaccaattgccacatcagaagaggtcaataatgccgcctgcatatacataaaatgattattacctgaagcatccacttgaaaaccaatacgcatcagcttatttttagcatcttcagccgttacgccagatgaacccaccccaaataaaaaaatacggcgtgcttttttaagtactttaacgacttcttcaagctgttttaaatcaagtaaattaatcgtttcttccattacattagcaaccgccgtttgcaatttttgtgcaatagtgagcgaatcatcacttggcataatttctgtttcaagtatgctttcatcttgattatctttcgtcgcaagttcaatagaaagctctagtttgaactcgctgaaacctttaaaaccaatggttcgacaaaaacggacgagcgtagcttctccaacttgcaaatgtttagcgatttctgaaagggagcattgagagactaaatcaggcgaacgcaaaatcgtatcggcaatttttttctctgatttagttaaactctggtaaagtgagccaattttgtttaacacatttcccgatttagccataaattgttccttcaggcttatccagtaaaacatcttttacccaataagctgcgccaattaaacctgcatcttgtccaaatttagcggtttcaatttcacaacaatatatcgaaggaaaatcttgtaaatatttttcaaccaaagataaatatccctcagctaatcccacactgccaccaatcgcgattttttgaatatctaaactaatcactaaatcagcaattaaattagcaatggctttcgcagaacgctcgacaagtgcggtcgctttttcatcattttttctaaaacgctcaaacacttcttttggatcgcacggttcttcccattgggaagaaactgcttcaattgctcgccctgaagcaatcgcttcgacacaacctcgacgcccacaaccacagatcgcaccatttggatcagctaatgtatgaccaatatgcccagcaataccacgagaacctgtctgcaaaatttggttcagcacaatccctccgccaactcctgttgaaacggtaataaaaacaaaatttgatacctgttcagaattttgcaattgatattccgcataagtcgcagcttgtgcatcatttaataaaccaatcggtttatccgtatgttttgcaatactcgctttaagtggaaattccgccaagccacctaagtttttcggatttaatgcacttaaaatgccattattgatgatccccgtagatgctaccgctacataatcaaactgcccttcataatcagcaagcaatttgcctaacgcttggtgcattccctccacgacattttcacgtggtgtatgaatttgctgacgttgctcaatttcgccattttttacaatcgccgctgcaatttttgtcccaccaatatctagtgctaaacaacgcataacttatccttatagtgtaaagtckttntctcacacgtcttacgactatcttgcagatttcactgaattagcaaaccaactcacaatatgttcaagacgagttaaggctgaacctacagtcacgcaatctgcaccaatttcaattgccacttttgccaattctggtgtgttataacgcccctcagccatcacaaaacaacccgctgattttaaatctttcactaattgataatctggttcttctggcactgcgccacctgtataacctgacatcgtactgccgacaatatcaaaaccaagcgctttacaatacaagccttcttctaaattaggaacaatctgccattgccaaacagcccatttcgtggatttttttcaccgcactttcaatatccacaggacgtggacggctcgtgccatctactgcaataatatccgcgccagcattggctagatcttcaatatcttgtaaaaacggcgtaatacgcacgggactatcaggcaaatcacgttttacaattccgataatcgggacattcacaaaaggacgggttgctttaaggttatcaacaccctcaatacgtaagccagaacgtccgcccataactgaagcctgagccatagcagaaacgatttcaggtttatccattgggccatcatcgacaggttggcaagaagaaataagaccatattgaatttgagaaagcacttcttgataagataatttagacatataacacccctcatttaaatctgaataaatcactttaaaattaatttaatccacacaaaacaatcttttataagttgtaatatgcttatattttcatcatttaaccttattatatgaaaaataaatgccattttaaagaatatttttgaagtgttttttcataaatgtgatcaacttctcattttggaaataaaactcgtaaaactattttaaatttgtttttttactcttagaattgctctcgaatcctattttgggggagaaaacatacatttttggcctaaattgattctcatattacggggttaatctatgcccctttccaacataagttcacacaggagcgaatatgatgaaattgacaaaacttttccttgccaccgccatttctttaggcgtatcttctgctgttcttgccgctgattatgacttgaaattcggtatgaatgctggaacttcatcaaatgaatataaagcggcagaaatgtttgccaaagaagtcaaagaaaaatcacagggtaaaattgaaatttcactttatccaagttcacaattaggtgatgaccgtgcaatgttaaaacaattaaaagacggttctctcgactttacctttgcagaatctgctcgcttccagctgttttaccctgaagcggcagtatttgccttaccttatgttattagcaactacaatgttgcacaaaaagccttattcgatacagaattcggtaaagatttaattaaaaaaatggataaagatcttggcgtgactttactttcccaagcttataacggaactcgccaaacgacttcaaatcgtgcaatcaacagtattgcagatatgaaaggcttaaaacttcgtgtgccaaatgcagcaacaaacttagcctatgctaaatatgttggtgcatcaccaacaccaatggcattttctgaagtttatcttgcgttacaaaccaatgccgtcgatggtcaagaaaacccgttagcagcggtgcaagcacaaaaattctatgaagtgcaaaagttcttagcaatgactaatcatattttgaatgaccaactttatttagtaagcaacgagacttataaagaactccctgaagatcttcaaaaagtcgtaaaagatgctgccgaaaatgcagcaaaatatcacactaaattattcgtagatggagagaaagatttagtcacattctttgaaaaacaaggcgtgaaaattacacatcctgatcttgttccatttaaagaatcaatgaagccgtattatgctgagtttgtaaaacaaactggtcaaaaaggtgaatcagctttaaaacaaattgaagcaatcaatccataatccctctttagtgtgccgtaatggccctacattcccttattcttcatcaaacggagtgagtatgaaatatattaataagcttgaggaatggctgggtggcgcattatttatcgccattttcggtattcttatcgctcaaattctttcacgccaagtttttcattctccgttaatttggagtgaagaactcgccaagctcttatttgtttacgtgggtatgttgggtatcagcgttgctgtgagaaaacaagaacacgtatttattgattttttaactaatctaatgcccgaaaaaatcagaaaattcacaaatacgtttgtacaattattagtctttatatgtattttcttatttattcatttcggtattcgtacttttaacggtgcatcattccctattgatgccttaggaggcatttctgaaaaatggattttcgcagcactgcctgttgtcgcaatattaatgatgtttcgctttatccaagcgcaaaccctaaactttaagactgggaaaagctatttacctgcaactttctttatcataagtgcggtcattttatttgcgattttatttttcgcgccagattggttcaaagtattgcgtattagcaattatataaaactcggttcaagttcagtctatgtcgccttactcgtttggctaatcattatgtttatcggtgtccctgtaggttggtccttatttattgctactctactttatttttctatgacacgttggaacgtcgtaaatgccgcaactgaaaaattagtctatagcctagacagcttcccattacttgccgtgccattttatattttaacgggcattctaatgaatacaggtgggattaccgaacgtatttttaattttgctaaagccttactcggtcattacacaggaggaatgggacacgttaatatcggcgcaagtttattgttctctggtatgtcaggttcagcacttgctgatgcggggggcttaggtcaattggaaatcaaagcaatgcgtgatgctggttatgacgatgatatttgcggaggaattactgctgcttcttgtattattgggccattagttccgccaagtattgcaatgattatttacggtgtaattgccaatgaatctatcgcaaaactctttattgcaggttttattccaggtgtattaattactttagctttaatggcaatgaattatcgcattgcaaaaaaacgaggttatccacgtacaccaaaagctacgagagaacaactttgcagcagctttaaacaatctttttgggcaatcttaacgccgttattaattatcggtggtattttttcaggcttattcagtccaacagaatctgccattgttgcagcagcatactctgtaattattggtaaattcgtgtataaagaattaaccttaaaaagcttatttaatagttgcatagaagcaatggcaattacgggcgtagtcgccttaatgattatgaccgtgactttctttggcgatatgattgcgcgtgaacaagtcgcaatgcgtgttgctgatgtgtttgttgccgttgccgattcgcctttaaccgtattgataatgattaacgcactgttactttttcttggaatgttcattgatgccctagcattacaatttttagtattaccaatgcttattcctatcgcaatgcagttcaatattgacttaatcttctttggtgtaatgaccacattaaatatgatggttggtattcttaccccaccaatgggaatggctctctttgttgttgctcgtgtaggaaatatgtcagtttccacggtaaccaaaggcgtattaccgttcttgattcccgttttcgtcacattagtattaatcacgattttcccacaaatcatcacatttgtgccaaatctattgataccataataaaaagtgcggttgaaaaacattaaattttttaaccgcactttcatcgttttcgtaagttacatctgccgtatcttacaatacaaaagggtgcaataactgcactttatcaacgcctattcaatgccgtttaatgaatagaaaactgtaaacacaactcaaaatggggtttattatgaaactaactaaaacagcattatgtactgcactttttgccacctttactttttcagcgaacgcacaaacttatcctgatttgccagtggggatcaaaggaggaacaggcgcattaattggcgacacagtttatgtgggattaggttctggtggcgataaattctataccttagacctaaaagatccttcagcacaatggaaagaaattgctacatttccgggtggcgaacgcaatcaacctgttgcagccgcagtggatggaaaactttatgtattcggtggtttacaaaaaaatgaaaaaggcgaacttcaactcgttaatgacgcttatcgctataacccaagcgataatacttggatgaaacttcctactcgttctccccgtggtttagtaggatcaagtggtgcatctcacggagataaagtttatattttaggcggctctaatctctctatatttaatggcttcttccaagacactgtggcagcaggtgaagataaagcgaaaaaagatgaaatcgcagcagcttatttcgatcaacgtccagaagattatttctttacaacagaattattgagctatgaaccatcaaccaataaatggcgcaatgaaggtcgtattccattctctggtcgtgctggtgcagcctttacaattcaaggtaatgagctagtggttgtcaatggcgaaattaaacctggacttcgcaccgctgaaacccatcaaggtaaattcactgctaaaggtgtgcaatggaaaaacttacctgacttacctgctccaaaaggcaaatcacaagatggtttagctggtgcgctttcaggctatagtaacggtcattatttagtcactggcggcgcaaattttccaggttcaatcaaacaattcaaagaaggaaaacttcacgcacataaaggtttaagcaaagcttggcataacgaagtttatacgttgaataatggtaaatggcgcattgttggggaattaccaatgaatattggttatggtttttctgtatcttacaacaataaagttttactgattggcggtgaaactgatggaggtaaggctttaactagcgtcaaagcaataagctatgacggtaaaaaattaaccatcgaataatttatcacagaatagtgcataaaatttataataatcaaaagcggcgaaatttatcgccgctttatgcaaaataaaagtaattaaagcaaaattaagacaaattttgaccgcactttaaatgcgctataaagagctggcatttttattaataagatttagcgatgttatttattccaccaccactactctgtttattcattgccatagcaatgtattttttgccaaagattgctagttattctgtccatttttcagtgattgtttttgttatttccctttcatttttgattgctttaagcagcgttatgcaatctttatatgtaaaacctccattaatcctcgtgactttaaaggcacaacaaaattagtttccacaggcatatttcgatttagccgtaacccaatgtatttaagtttgctgttaattttgcttgcttggacgctttggttaggtaatagtttggcttggttaggcgtaattatctttatattagtgataaaccagtttcaaatagcccgagaagaaacctatttggaaagtaaatttggcgatgaatatcgtcgttacaaacaaaaagtaagacgttggctataaaaaaacaccttcacaaggaaggtgtttttatcaaattaaactctattttttcggtgcctgcataaagcggaagaaatcactatctggttttaaaatcattatattgtcagaatttgcaaaactcgcttcataggcttttaagctacgcacaaaagtaaagaattgtggttcttgagcaaaagcatctgaatataattttgctgcagctgcatcgcctgaacctcgtaattcttgtgcagttttatttgcattagcaagaattaacgtcactttgcgatctacatcagcttgaataaatgctgctttttctttcccttgagaacgatgttcacgcgccactgcatcacgttctgcacgcatacgttggtaaattgaagaagagacttcatctggtaaattaatttgttttacacgcacatcgatcacttcaatacctaattctgccgtactgtcttgtcctgaacttaaagctttttttgccccttccattaattctccacgtgtaccagaaacaatatctttaatcgtgcgtgaaccaatttcagaacgtaaacggtcgtttactttacgacttaataaatttgcagcttgagcataatcgccaccgccagtagatgtgtagaatcgaccaaaatcactgattttccatttcacataagaatccactagcaaatcttttttctcaacagtaacaaaacgtgttgcagagccatctaaagtacgaatacgtgcatctaaaactttgatgctatcaattaaaggcactttaaaatgcaagcccggttcatatacaaccactttgttatcagcatcacgctgtactttgttaaatcgtaacataatgccacgcgtaccttccgttacaacgacgatactagaataaacgactgccgcaatcacgaaaataacaggtaataaaaatctacgcattagttaaatctcccttgacgaatcggcgcaacggtagtcggctgaggctgataagaattttgacgttctggtgcagtaaaagcaggcgaagaattgaccgcacttggcgcacttgttaccgattttttgcccataatttgctctagcggtaacacagttaaattattaccattattgccatcaagcattacttttggggtatttgccatcactttttccatcgtctgaatatataaacgctcacgcagtaaatctggcgcagccttaaattctggcaacaagcgttgcaaacgttccacttcaccttttgcatctaacacgatacgatctttataagctgttgcttcttcaagaatacgttgcgcatcaccacgtgcaatcggttctttctcacgcgcataggcttccgcttcacgaataaaacgttgttcatcttcctgcgctttaattgcatcatcaaacgcatcttttacttcttcaggtgggcgcgcagattggaagttcacatcaataacctcaagtcccatatcataggatttgataatttcattcaaagctttccaagtattttcacgcacgacagagcgacctgtggttaaaatatcattcatagacatatgcccaataacataacgtaatgcactatctgtcgcttgattcaaactatcatctgcatttgttacgctaaaaagatattttgcaggatcttgcacacgatattgcacggtcatttccacttttaccatattttcatcttgagtcagcattgcaccttgtgtacgcaactcttttacttgctccacatttactggcaatactttatctacaaatgttggtttccagttcaaaccaggttgaacaatagaatgtaactcgccaaaacgaagcaccacaccgcgttcagcctctttaatggtgtaaaaaccgtttacgccccaaataatcgcaccaatcgctacagcaagtggaataactttaccaaaatgaaatggcgtattgccttgagaactgccattattttgaccgctctttttatttccaccacctaattttttaagcagattattaaaaatctcctcaatatctggtggagattgctcttgatttccacgattttgattgttattccatccattattattggatgaatttcccggctgttggtcgttgctttgccctggtttactccaaggatcgcgatctgaaccgttctgtgacatttcattctccatttgtcaaaaaattgttaagagtttagctaaataaatggggcacgtctatgaaaatacaaggctttttaggcaataaaaaatccttgattttatataaggatttttttgattaattcacttcataaagaacatatttttcaagttcttttatctgtaaactttctctattccattcataaaagtgcggtaatttttcttgatgattgacaaaagcggctaaataaatagggagttcatcagtaaaccacaactgcccctgcggacaataatctgaaaaaattttttgttgttcaggaaaatgacgaacattggataattttacgatcccaaatccttgagatttcaatacagcctctcgcaaacaccaacaacgataaaaagcgttcaaagaatcctgctgatgatgaaaccaatcaatttcttcttttggtgcaatatgttccatcaacgccgtaaaatttcttattttaggaaattcaatatcaattcccaccgcacttttttcttcatttctaatatctaatattaccgccacccaatcaccagaatggctaatattaaaatctattcgctcatcaagaaaataaggtctgccactttcagtacgatgaatttgagataaaagtgcggtggattttcctgctatttttagaagttggaaaagtaataaatgcgcaagccgacgacactgatgacgctgaaaaacacgggagctatccgtttcaatttgatatagattttctggaatcagttcatcgggtaaggattccaaagaaaaaggttgatttatattgccgtaggcgatgtaggttgtcataaaataaaagcaccattcaaaggtgcttttatattaaaaggatttagtttgtgtgtaaattagcgaatcactaattccgccacagaaacaccgaccaagcaagcaacaacaaccccaattaaacctggcaccataaaactgtggttaaaataatatttaccaatttttgttgtacccgttacgtcaaagtttactgttgcaatatctgacggataatttggaatgaagaratacgcataagttgcaggcattaaaccaactaagattggcgcaggaatacctaaaccaataccaacaggtaataacattacggctgttgctgcttggctattaattacaactgagactgcaaataacgccaatgcgaatgtccaagggtaagtttgcaccatatcagtaatcgcggctttaaattctggcattgcatatttgaagtaagtgtcgctcatccacgcaataccataaattgcaatcgctgctaccatacctgacttaaataccacaccattttgcacgatttgaggattcgttttcgttgcaagtaaaatcacaccaccaaaacaaagcatcatcatttgaatgataagtgacattgaaattgcttttccgctaccgatagtgcgaatttcaggaatcatcgcaatcgcaacaatcacaactaaagcaagtaaaaataggtaaacagatttttttgccccttgcggaagggtttcattcaatgttgtactggtagtatttaaaatacgttcgcgccatactggatcttgtaaacgacgttgatattcaggatcttgttctaactctttaccacgacgcatactgtataaagaaagtgcaatcgtacccgctaaggttgcaggaacggttacgcaaataatatctaataaactaatatgctcaaaagcgggcattgctgtaattttacctagataaaatacaacagctgcagaaagtgggcttgatgtgatggctaattgcgatgctaccgaagacgctgccattggacgttctggacgaattttgtttttcaatgcaacatcgccgatgattggcataattgtgtaaacagagtgacctgtaccaagcataaaggttaataaatagacgactaatgggccgagtaaagtgacacgttttggatttttacggagaatgcgttcagcaatttgtaacataaatttcaaaccgccagctgcttcaagtacggatgcgcaagtcaccactgcaagaatgataagcataacatcaatcggtgcttccccactggcatacgaaatacgaaaacctcgatagcaagaccgataccagaaacaacacctaatccgataccgccgtaacggctaccgatatagagcattaatagtaaaaataaaaattctaaataaagcataaacacctcaaaaatggaaaactatgcaaataatacttctttttaggcatataactaaattattttttaaaatttaaaccaagattttaagtaaacgataatttagatcaatttttatgaaaaggaaaaataaaaagtgcggtaattttaaagaggattattagaaaaaaaattagcgacttaaaacgtcgcccaacttaaaattattgattgttttgcacgtaatcaatcgcagattgaacagtggtaattttttcagcttcttcatcaggaatttcaatatcaaattcttcttctaaagccattactaattcaactgtgtctaatgaatctgcacctaaatcttcaacaaaagaagcttcaggtttaacatcttcttctttaacacctaattgttcaacgatgatttttttcacgcgttcttcaatactcatttgtttttcctatttgttagttttaactcataaaagagtggttagtgtatgtattttttagtaacttgcaactattttatggtctggtcgcaccacaaaataggcaatgtgaacacacacatcaaatatagttacgtacctttgcatacgctcaaggcgtaaccaagttacattgcgagcgggattttagcattatctaaaatctttggctatgattttattgcttagaaatcccccataaatcaatgtcaaattttagcttaagtataagccaccattcacgtgtaacgttgttcccgtgatataacctgcatcatcagaagctaagaaagcaacggctttagctatgtctttngcttcgcctaaacgtccagctggaacattagataagatccccgcttttkgttcatccgtaagcacttctgtcatatctgttgcaataaaaccaggagcaaccacatttacagtaataccacgtgcagctacttctttcgctaaagatttagaaaaaccaaccacacccgcttttgccgcacaatagttagtttgtcctggattacccgttgaaccaaccactgaaccaatattgatgatacgaccaaaacgttttttcatcattgaacgtaacatggctttagaaagatgatacaccgaagttaagttagtttgcataatatcaaaccattcctcatctttcatacgcatcaataaattatcgcgagtaatacctgcgttattcacgagaatatcaatatcgccaaaatcatttttaatttgttcaagtaaggtttcgatagattctttatccgttacgtttaaaactaaacctttacctttatcccctaaataagccgagatcgcctctgcacccttttcagaggttgctgtaccaattacaaatgcaccttttgaactaagttcttctgcaatcgcacgaccgataccacgggtagatcctgtcactaaagcaattttaccttgcattttttcttccttttacttacactaaaaattcttctaccgcattgaatgatgcaacatcatttacagatattgcttgtaaatcacccacaatgcgtttggttaaaccatttaatactttacctggccccacttcagcaagcactagaacgccatcttgcgccattttttcaactgtttcagtccaacgaactggactatataactgacgcacaagtgcggtacgaatttcggtgccttcagtttcagctttcacatcaacgttatttaataccgatattgttggtgtattaatttgaatattctcaagtgttaccgctaattgctcggctgcaggtttcattaatgcacagtgagaaggtacgctcacagctaacggcaatgcacgtttcgcccctgcttctttacataatgcagccgcacgctcaactgcagctttcgcacccgcaataactacttgacccggtgagttaaagttcaccgcagatacgacttcgccttcctctgcttgtttgcaagcattaataattgcttcattatctaaaccaatgattgcatacattgcgccagtgccttcaggcacagcttgttgcattaattttccgcgcaattccactaatttaatcgcatcttggaaatccaacacgccagcacaaactaacgcagaatactcacctaagctatgacctgccatcacttctggttttaattgaggaaatttttctttccatacgcgataaatagcgactgaagcagctaaaagtgcgggctgagtttgccaagttttattaagttcttcagctggaccttgttgaacaagataccataaatcataaccaagcgcatcagatgcttgtttaaatgtttcaataacgattggatattcagttgcaagatcagcaagcataccgacagtttgggagccttgacctgggaagaccattgcgaattttttcattatgttttgtcctattgttttttaattgaaaattcttcttcggtaattaaaatcgggtttcgccgatggcgagcttactttttctttgcttcgccaaagaaaaagtaagcaaaaagaaaggcgcccctacttttccttgtttcctttgttccattgaatttgccttaacggaaattttctgaactcgctacgctcaaacagacgaaaatttcctacaaattcaattccacaaaggtggaaaagaagggaacccaatttgttctttatccgatttaaagtgcggtcaaaactcaaaatattttttgttcttaaaatgaatttaaaattaaccgcactttttaaataatgctctgataaattcggggccccatataaatcacctttgcgactttcaattttcaggcaatttgcgtctgtttgagcgcagcgagttcagcaaattgccgttaagaaaattgaaacaaagcaaagaacagcgatttaactggggcgtgttttctttgcctactttcttttacacgagtaaaagaaagtgagtcgccgtcaggcgaacccctgacatttaacacaaaaagtgcggtcaatttttaccgcactttaaaatcatcaataattatatcaaatcaactaaaatctcactaacgctgaaccccaagtccaaccaccgccaaaggcttctaataatagtaactgcccacgttgaatacggccatctcgaatagcctcatctaaagcaacaggaacagttgctgcactgttattagcgtatttatctaacgttaccaccacttgcgacatatccatttctaattttttagctgttgctgtaataatacgtaaatttgcttggtgtggcacaagccagtctaaatcttttttatctaaattattggctaaaagtgtttcttccaccacatttgaaagttcacgaactgccaatttgaacgtttcgttaccttgcatctcgatatagccagatttttctataccacgttctggctgagctaaaacaagggcattatttttatctgctgaagcgtgtaaatgggtggagataattccttcttgttcactcgcttctaaaattacagcacccgcaccatcaccaaatagcacaacagtgctgcgatctgtttcatctaatttacgagaattgagatctgagcctatcactaaggcttttttcactttgcctgcacgaataaattgatcagctacgctcaaagcatagacaaagcctgtgcaagctgccgccaaatcaaaagaaatcgcatcatcaatatttaataaaccttgcacttggcaagccgcacttggataagcatgtgagtgacttgtagttgcaacaataatcagttcaatatcttgaggattaatttgagcagcttcgatcgcattttttgccgcttcaaatcccattgttgcaacagtttcatcttccgctgcgatacgacgttcacggataccagaacgagtgacaatccattcatctgatgtatcaaccattttttctaaatccgcatttgtgcgaatatggctcggcagatagctaccggtggataaaattctactattcatactcaataagataagcgattaaaaaggaaaaaatctatggactatcgccaagtaagagataagaccacaccggattattttccgatgttaaaggaatgcagatagtaatacggggaccaacgtccccgcccatcacatctaacgccaaggttagacggttcaagtgaacacctataagtaaaaaattacttattgatcactttacgaccacgatagtaaccgtctgcagttacgtggtggcgtaagtgagtttcaccgcttgctttatctactgatacagcagcagttgttaaagcatcgtgtgaacgacgcatatcacgacgtgaacgagattttttgttttgttgaacagccattggctatactcctaaatttaatttacttttgctttaaattagctaatacagcgaacgggttcggtttttttgccaattcttcaggcaatacgccaaaaacctgttcctgcgcggacacttcacagtgttcagatgaatgcattggtacaagcggcaaagctaaaattagctcatcttccaccgtgccaattaaatctatttcgccaaactcattgaactcgattggctcataaatttcgggcaagtcatcagcctgatcccaattagccactggactataagtaaactcacattccaatgtttgtttgtaaggttcgttacaacgctgacattcaagatcgacatcaatctgtactttacctttcatcaccactaatttttgtggatcaacataaaacgataatgttacctgtgcatcgctgagcacgtttaccactgattccgccaaacgctcaagctgatttgccgcataataaccaacataatcaagccgtctttgagcatcttttatgggatcaacagtgaggggtagttttaccttttgcatagggcgtgaatattacctgttgttgcgaagatagtcaaagggaaatcacattttttattggataactcaataaaggaaattatccgctaactaaaaaggttggaactataacaaaaattgctataatcacgcctctttttttaacaaggaaagataatgatgacttcaaattcttattggcaacgcttaaaagtggcatttcaatatgtcatgccacaaatttatttaactcaaattgctggctggtttgctaaacaaaaatggggcaaaataacacattttgtaattaaagcttttgcgaaaaaatacaacattgatatgagcattgcgcaaaaagaacaattttctgattacgcaagttttaatgaattttttattcgtccgttaaaagaaaacgcacgtccaattaatcaaaatccaaccgcactttgtttaccagcagacggtcgcattagtgagtgcggtcatattgacgataatcttttattgcaagctaaggggcattttttcagcctagaagacttattggcagaagataaagaattagtggaaacctttaaaaatggggaatttgtaactacttatctttctcctcgtgattatcaccgagtgcatatgccatgcgatgctacgctacgcaaaatgatttatgtgccgggtgatttattctctgtgaacccatttttagcccaacatgtaccaaatttatttgcacgtaatgaacgtgtgatttgtgtatttgatactgaatttggcacaatggtacaaattttagtgggtgcaaccatcactgcaagtattggcacaacttgggcaggcgtaattaatcctccacgccacaacgaagtgaaaacttggacttatgaaggcgaaagtgcggtcaaattattgaaaggtcaagaaatggggtggttccaacttggttcgacagtaattaatttattccaagcaaatcaagtgcgtttagctgatcatttaagcgttaatgaacctgttcgcatgggcgaaatcttggcatataaaaaataaacaggatttatttccataaatgacagaaacaaatcctgaaagtagatatttctcacttctttaaaggcagtataaccttactgcctttttcttctttcatttgaacaattaacgcattgttacaaattcctctgaacctgttggatgaattgccaccgtattgtcaaaatcagcttttgttgcacccattttgattgctacagcaaatccttgaatcatttcatctacaccaaaaccaataccatgtaaacccacaactttttcatctttacccacacaaactaatttcattttgcacggttggcgatgttgagttaccgcagtgtacatcgctgtgaaagaagatttatataccttaacattttctgcgccgtactgctcaatcgcttgcggttcagttaaacctacagtgccgataggcggatggctaaatacaacggttggaactaaactgtaatctaaatattcagtcggtttattattaaataaacgctcagaaaggcgacgacctgctgcaactgcaactggtgttaattcaatgccgttttcgataatatcgcctaccgcataaatgcctttcacattagtattttgatatttatctactttgacatagccatgttcgttcgtttctacgccagcattttctaagccaattttatctgtcgttggaacacgacccgcagcccaaataacgcaatctacggtaacatcagattgaccatcacatcttacagtaagtgaaccatctgcattttttacaatttcagatggggtagaattggtatgtaattgaattccatcttgcgcaagcacttccactaatgtttctacgattaatggatcctgattacgcattggcgcatggcgacgcactaataaatgtgtttccacgcctaagctatttaatacgccagaaagttcaacagcaatatagcctgcaccaataacagcagcacgttttggtaattcggttaatgcaaagaaaccatctgaatcaatgccgtattcttgtcctttaatatttggacgatatggacgaccaccagttgcgattaaaatatgatctgcggttacttgttcttttgtaccatcagcaagtgttacttcaatggtatgggcatcgacaaattttccgaaaccattaattacatcaatattatttttcgctaatacattattataagatgtatggatacgactaatataggcttggcgactttcaatcagttttgaaaaatcaaattttttcacttcaacatcaaaaccataatctggcgcataattgttgattgcttctgcaatatgcgcaccataaaacatcacttttttaggtacacaaccgacatttacacaagttccgccaagatgttttgcttcaatgattgcacatttttttccatagcttgctgctcgatttagagacgcaataccgccactgccaccgccaatagcaatataatcataatgtttagtcatagtttgaaccttttttaaactaaaatttttttgtattctgcctaatttttataaagaatgctataaattgatgtaattggttttatgaatattttttactcttttgaacagatgattagtttgaaatgattttatgtgaagcctagtatgtagaatgaaatagcgtgatagaaaaagaggaagattgttcaatcttcctcactgtagatatgtgattaattagaatattggtttatcgcagccgcaacttcttgatcttgataaatattgttcacaatatcattaaaagtttgagatagcactttatgaatttcatcattgcccgcattaaatacgccctcttgtgagtgcgtgacattaaatgatttattatacgaacctttcgcaccttgtacataaactgtcgcttgaattttggtattaagtttataacgaagattaccttgttctacttgcgtaccaaattcacgcacatccacagttacccacgcatttgaaccatttaattgcccaactctaaaacctttactaattaaattttgctgcatcacttgctgaaataattgtgtaacacttggggatgcatttaatttaatcagttccccgtgtttcgtataactcgcaatctcttgtattgcacggctatcttttgttgtcacagatacaacggcagttcgattaacattcattgaagcacttggtgcaggcggtgtaaatgctaatatatttgattgtgcttggcagcctgcaagaaataatgtagccgctagaatacctactgatgataatgttttaattttgtttactaatgccataatttccccataaatcaattagaattgtgctattcttacaaacttccttattaatgtatagcgtttcattttagtttttgtggagaacttataatgtcaattcaacaaattattgagcaaaaaattcaaaaagaatttcaaccgcactttttagcaatagaaaatgaaagccatttacatcactctaatcgaggttctgaatcacattttaaatgcgttattgtcagcgcagactttaaaaatattcgaaaagtacaacgtcatcagcgtatttatcaattattgaacgaagaattaaatcatagtattcacgcattagcattacatttattcactccagaagaatggaaagcacaaaatgaaactgtaccgcactcaacaaaatgtgcaggtattggtcgttaattttgttataaaaatgtaacatttttgatatatcgcaaaaagttctaacaaaaaaccctctgtttaagtagcgaaaaacagagattttcgctagaatgaggcgtttaatttagtccaaattcgatttctcggtaaaattattaactgtgaaatcaatccatttgagttttttattttgtgacattaatgtttttttagcggtttgtcacactcaaacgtgagattgcttctagggtatttttactatattagcaattgtatttttaaccttgaaaagtagtgcaaatagtatgattacaattaagaaaggtttggatctcccaattgcgggaaaaccagcacaagtaatccatagcggcaacgctgtgaatcaagttgcgattctaggtgaggagtatgtggggatgcgtccttcaatgaaggtgcgcgaaggcgatgttgtgaaaaaaggtcaagtactttttgaagacaaaaaaaatcctggtgtaatttttacagcccctgcaagcggtaccatcactgcaatcaatcgtggcgaaaaacgtgtattacaatctgttgttattaatgtagaaggtgatgaaaaaatcacttttgcaaaatatagcacagaacaattgaatacactttcttctgaacaagtaaaacaaaacttgatagaatctggcttatggacggcattacgtactcgtccatttagtaaagttccatccattgaaagtgaagcatcttctatttttgtaaatgcgatggataccaatccattagcagccgatccctctgtcgtattaaaagaatattcgcaagacttcactaacggtttaaccgtattaagtcgtctattcccttcaaaaccattacacttatgtaaagcaggcgattctaatattccaactgctgatcttgaaaatttacagattcatgattttactggtgttcatccagctggtcttgtagggacgcatattcactttattgatcctgtcggtattcaaaaaactgtatggcatatcaattatcaagatgtgatcgctgtaggtaaattatttacaacaggcgaactttattcagaacgagtaatttctcttgcaggtcctcaagtgaaagaacctcgtttagtacgtacaacaatcggtgctaatctttctcaattaacccaaaatgaattaagtgcaggtaaaaatcgtgtaatttctggctcagttctttgtggtcaaatagcaaaagattcacatgattatttaggtcgctatgctttgcaagtatcagtaatcgctgaaggtaatgaaaaagaattttttggttggattatgccacaagccaataaatattctgtgactcgtaccgtattagggccacttcagtaaaaaattgtttaattttactacttcagaaaatggtggcgaacgtgcaatggtgccaatcggtagctatgagcgcgtaatgccattggacattttacctacattattattacgtgatttaatcgtgggcgataccgatggtgctcaagagttaggttgtctggaattagacgaagaagacttggcgttatgttctttcgtttgtccaggcaaatatgaatacggttcaatcttgcgtcaagtcttagataagattgagaaggaaggttaaaaatgggtttgaaaaatctttttgaaaaaatggaacccgcgtttttacccggtggtaaatacagcaagctttatccgatctttgaatcgatttataccttgctttatacaccaggtacggtaacgcacaaaaacactcacgttcgtgatgcgttagattcaaaacgtatgatgattacggttttccttgcgttgttccctgcgattttctatgggatgtacaatgtgggtaaccaagcgattccagcgttaaatcaattaggcaatttagatcaactaattgctaacgattggcactatgctcttgcaagttcattaggtttagatttaactgccaatgcaacttggggctctaaaatggctcttggagcaattttctttttaccaatttacttagtggtatttaccgtttgtactatttgggaattgttattctctgtggttcgtggtcacgaagtaaatgaaggaatgttcgtttcaaccattttatttgccttgatcgttccaccaacattgccactatggcaagccgcattaggtattacttttggtatcattgttgcaaaagaaatttttggtggcgtaggtcgtaactttatgaaccctgcacttgctggtcgtgcgttcttattcttcgcatatccagctcaaatttcaggcgatacggtttggactgccgcagatggtttctctggtgcaaccgcactttcacagtggtcacaaggtggtcaaggtgcattgcaacataccgtaacaggggctccaattacttggatggatgcttttgttggtaacttacctggttcaatgggggaagtttctacccttgcaattttaattggcggtgctgttattgtattcactcgcattgcagcttggcgcattattgctggtgtgatgattggcatgattgcaacctcaaccttgtttaacctaattggctcagagactaaccctatgttctcaatgccttggcattggcactttgttttaggtggatttgcattgggtatggtatttatggcgaccgatcctgtttcagcatcttttactaatactggtaaatggtggtacggtgcattaattggcgtaatggctgtattaattcgtactgtaaacccagcctatccagaaggaatgatgttagcgattttatttgcaaacttatttgcaccgattttcgactacatcgttgttcaagcaaatatcaaacgtcggagagcaagaacaaatggctaagtttaataaagacagcgtaggcggcacaatccttgttgtgctactactgagtttagtttgttccattattgttgctggttccgcagtaatgttaaagcctgcacaagaagaacaaaagttactcgataaacaaaaaaatatcttaaatgtagctggtcttttacaagaaaacacgaatgtaaaagaaacttatgcaaaatttatcgagccccgtttcgttgatttagcaacgggtgaatacacacaacaagcagatgatagccaacaagcaattcctgctgatgcggataaagcacgtattcgttctcgtagcaaaacaactgaagtttatcttgtaaaagatgaacagggtcaaactcaacaagttattttaccaatttatggcactggcttgtggtcagtgatgtatggcttagtatctgttcaaccagatggtaatactattaatggaatcacttactatcaacacggagaaacaccgggattgggcggagaaattgaaaatccaaactgggcaagtctatttaaaggtaaaaaattatttgatgagcaacatcaacctgccattcgtattgtgaaaggtcaagctccacaagatgaacatagcattgatggtttatctggtgcaactttaacaggtaatggtgttcaaggtacctttaattattggttcagcaaagatggctttggtccatatcttgaaaaacttcattcaggagcaaactaatgtctggaaaaacaagttataaagatctgttgttagcgccaattgctaaaaacaaccctattgcattgcaaatcttagggatttgttctgcattagctgtaacaacaaaattagaaactgcttttgttatggcgattgcagttaccttagtaactggattatcaaacttatttgtttccctaatccgcaattatatccctaacagcattcgtattattgtacagctcgcaatcatcgctcgcttgttatcgtagtggatcaaattctaaaagcctatgcttatggtttatctaaacaactttcagtattcgttggtttgattattactaactgtatcgtaatggggcgtgctgaagcatttgcgatgaaatcccctccagttgaaagttttgtagatggtatcggaaatggcttaggttatggttcaatgttaattatcgtagcatttttccgtgaacttatcggttcaggtaaattatttggtatgacgattttcgaaactattcaaaatggtggctggtatcaagcaaatggtttattcctacttgcaccaagtgcattctttatcatcggatttgtgatctggggattaagaacttggaaaccagaacaacaggagaagtaatcaatggaacattatattagcctatttgttaaggcagtcttcattgaaaatatggcactttctttcttcttaggaatgtgtactttcttagcggtatctaaaaaggtgtcccctgcgtttggtcttgggattgcggtaactttcgttcttgggatcgcagtgccagtaaaccaattaatttatgcaaatgtactaaaagagaatgctttaattgaaggtgtagatttatcattcttaaacttcatcactttcattggggttattgctggtttagtgcaaattcttgaaatggtattagataaatttatgccatctctttataacgcattagggatttcttacctttaatcgcagtaaactgtgcgatctttggtggggtatctttcatggttcaacgtgattacaatttccctgaatctatcgtgtatggtttcggctcaggtttaggttggatgttagcgattgtagcgcttgctggcttaacggaaaaaatgaaatacgctgatattcctgctggattaaaaggtttaggtattacctttatctctgttggtttaatggcactaggctttatgtctttctctggtattcaattataaggagtgtaatcaatgagcgattcagtaattcttgcactcggtattgccgcattcacggttattgtattagtgttagtggcaatcatcttatttgcgaaatcaaaattagtcgattctggtgatattactatcgacatcaatgacgatcctgaaaaagcgatcacattacctgcaggtggcaaattattaggggctttagcaagtaaaggtattttcgtgtcttctgcttgcggcggcggtggctcttgtggtcaatgtattgttaaagtgaaaaatggtggcggagaaattcttccaaccgaactttctcacattaacaaacgtgaagcaaaagagggatatcgcttagcttgtcaagttaatgtaaaaggtaatatggaagttgaacttccagaagaaatcttcggcgtgaaaaaatgggaatgtactgttatttctaacgataacaaagcaacctttatcaaagagcttaaattggctattcctgaaggcgaggaagtgcctttccgtgcaggtggttatatccaaatcgaagctgaaccacatgtggtgaactataaagatttcgatattccagaagaataccacgaagactgggataaatatgatttatggcgttatgtctctaaagtggacgagcatattatccgtgcttactcaatggcttcataccctgaagagaaaggtatcattatgcttaacgttcgtattgcgactccaccaccacgccaacctgatgcgcctccgggtcaaatgtcttcttacatttggtcattaaaagcaggagataaagtcacaatttctggtccatttggtgaattctttgcgaaagaaactgatgcagaaatggtatttatcggtggtggtgcgggtatggctccaatgcgttcacatatcttcgaccaattaaaacgtttacattctaaacgtaaaatgtcgttctggtatggtgcacgttctaaacgtgaaatattctatcaagaagactttgaccaattacaagctgaaaatccaaactttgtatggcacgtggcactttcagatgcattgcctgaagataattggactggctatacaggctttattcacaatgtactttatgaaaactacttgaaaaatcatgaagcaccagaagactgtgaatactatatgtgtgggcctccagtgatgaatgcagctgtaattaaaatgttgaaagatcttggtgttgaagatgaaaacattttattagatgactttggtggctgattttagttaatcaattcatcataaaagctgcccgcactttgtgataaagtgcggncsaaatttaagatgtttttaaacattttctatgattacaggtaagttttgttgagtttgccagtaattcaccaatttaggaaatccagatgaaaaaattaataagcggtatcatagcggtagcaatggcattaagtcttgctgcttgtcaaaaagaaacaaaagttatctctttaagcggtaaaacaatggggacaacttatcatgttaaataccttgatgatggttcaataacagcaacatctgaaaagacgcatgaagaaattgaagcaatcttaaaagatgtaaacgcgaaaatgtccacttacaaaaaagattcggaattgagccgcttcaatcaaaatacccaagtgaacacaccgattgagatttcagcagattttgccaaagtattagctgaagcgattcgtttaaataaagtgaccgaaggcgcgttggatgtaactgttggccctgtcgtgaatttatggggatttggtcctgaaaaacgccccgaaaagcaacctacaccagaacaattagctgaacgccaagcgtgggttggcattgataaaattaccctagatactaacaaagaaaaagctacattaagtaaagcacttcctcaagtttacgtagatttatcgtcaattgctaaaggctttggcgttgatcaggtggctgaaaagttagaacaattaaatgctcagaattacatggttgaaatcggcggtgaaattcgtgcgaaaggaaaaaatattgaaggtaaaccttggcagattgccattgaaaaaccaactacaacaggcgaaagagcggttgaagcggtcattggattaaacaatatgggaatggcaagttctggcgattaccgtatttactttgaagaaaatggcaaacgctttgcgcacgaaattgatccgaaaacaggttatccaattcagcatcatttagcctcaattacggtacttgcaccaacctcaatgactgcagatggcttatctacagggttatttgtgctgggggaagacaaggcgttagaagtggctgagaaaaataatcttgccgtttatttaatcattagaacagataatggttttgttaccaaatcatcctctgctttcaaaaaattaacagaaacaaaagaatagttatgcaaactttattttttactttaatcgctttcgtcgcaattatattgttgatgtctatcggatttattatcaaaaaacaaagtttaaaaggcagctgcggtggtttatctacccttggtattgccaaagcttgcgattgtgataaaccttgcgacacgcntcaatcaaaattagatgcaggcgatgracaagcgaaagctgaatatgagcaaaaatttgcgaaaaaagatgatgactcgcaattttatcaagtgaaataacttgctcaaaaatgaccgcactttatgtgcaaaataaaattaacggcaaaattattttgccgttttctcattcaatgaccaatgtgcttcgccttaaccgaagttacgggagaactatgttaatttcaaatacttataatcaacactttcctcaattgacgcaagagcagcttgcgagaaatgcgacaaaaaaagtcatttgtggtatgtctggtggcgtggattcttctgtgtcagcgtttattcttcaacagcaaggctatcaggtggaaggcctgtttatgraaaactgggaagaagatgatgatacggattattgtactgccgcagctgatcttgcagatgctcaggctgtatgtgataagttggggatcaaactacataaaattaattttgcggcagaatattgggataatgtctttgagcattttttaaccgaatataaagcagggcgcacgccgaacccagatattttgtgtaataaagaaattaaatttaaagcatttttagaatatgcagctgaagatctcggtgcagattatattgcaacagggcattatgtacgtagagcgggagataatgaaaatgcaaaactattacgtggtttagatcccaataaagatcaaagttattttctttatactttaagccataaacaagtggggcaaagtttattccccgttggtgaaatcgagaagcccattgttcgtgctattgctgaagatcttggcttaattacggcgaagaaaaaagattctacagggatttgttttattggtgagcgtaaatttaaggatttcttagcacgctatttaccagctcaaccaggtaatattcgcactgtagatgatgaaattattggtcgccatgatggattaatgtatcacacattgggacaacgcaaaggattaggcattggtggtctaaaaaatgcgggagatgaagcttggtatgtagtagataaagatgtagaaaataatgaacttattgtcgcacaaggtcacgatcatcctcgtttattttcaaaaggattgattgccagccaattacattgggttgatcgcgaaccaattcgagagtcattacgttgcacggtgaaaacgcgttatcgccaacaagatattccttgtgtgattgaaccaattgatgatgaaaccattcgagttatttttgatgaacctcaatcagcagtaaccccagggcaatctgccgtattttaccttggcgaagtttgtttgggtggcggtattatcgcagaaagaatataaaacaaagatgactaaaagcgcgtaaaatgcgcttttaaactatttattcaaaccaaatgacgctcgccattcgtcccgtttgattgtccctgcgataagaaaagaacttttctttttcgttgaatgtacagtgatttccaccataaatttgcgtaatacctagattgtttaatcgctgagttgcaatttgataaagattactcaggtatttaccttcttcgattgcatcaggttgaaaggcgagtttggctttttcatctactacaacaaacttttctacaacatcaatcccaacttgaaaggcctttggacctattgcagggccaaaccacgcgataatatcttcaggtttagcttgaaaatatttcactgtttcttctagtacaccatcgcataaaccacgccagccagcatgtgttgcagccacttcattgccagatgttgtagtgaatagaactggcaaacagtctgccgtcataacaacgcaaacttgattgggaacatttgtataaactgcatccgcttcaagattttgtcctgaataaggtaattgaatcactcgagtactgtgtgtttgagttagaaatataggtgtttgtggcaaaccaaatttttctactaataaagtgcggttggtttttaccgcacttttgttatcaccgacatgatcgcctaagttgaaactcaaataaggcgctaagctcacacccccttcacgagtagtggtaaaggcatgaatattctttggaacattccaattggggttaattgcttgcatattaataatctaactcatcttgatgttcgagatagtcggctttgagggcattaagcaattcaacgaaatcatctggtaatggtgcataccattccatcatctcccctgtgattggatgagctaagcgtaacatgaccgcatgtaaagcttggcgtttgaaattacgcaatacttccataaagtcttcactcgcattttttggtggacgagggcgtccgccataggtttgatcgcctagcagtggatgggcaatatgtgccatatgaacgcggatttgatgggtgcgccccgtttctaaacgtaaacgtaaacgggtgtagttacggtaattttccataatacgatagtgggtaacagcgggttttcccattggatgaaccgccattaaagtacgtttggttgcatgacgagccataggttgatctactgtgccacctttagtcataatgcctgaagcgactgcttcatattcgcgcgtaattttacgtttttgtaggtcacgtactaacttagtttgagcaggaatggttttagcaacaaccattagacctgttgtatctttatctaatcgatgcacaattcctgctctcggtacttctacaatcggcggataatgatagagtaacgcattgagcacggttccatttggattgccagcaccagggtgtaccacaagatcttttggtttgttaatcacaataatatcatcatcttcatacacgatattcaatggaatattttctgcttcaaaacgtgtttcatcttccacttcaacaataatctctattctctctcctccaagcactttctcacgcggaatattagtaatgcggtcgttaagttttacgagatcggcttcaatccatgtttttaatcgggaacgagaatattcagggaacaactctgcaagtgtttggtctaaacgttgtcccatttgttctggctgcacttcagccgaaagggtaatttgtggcataaatagctctcaaaaattttaaaagttggcttattgattaatgttctatacaatagcggacaattgtatcttatttattggttttcgtaaaaattaaggaaaaaacaatgcgtaaaataaaatctttggcattgcttgccgtggcagcattggttattggatgttcaagtggttcaaaagatgttgaacaagcatcggtaaatgaattatacacaaaaggtacaacatcattacaagaaggtagttactctgaagccattcgctatttaaaagcgacgactgagcgttttccaggtagcgtttatcaagaacaagcaatgttagatttaatttatgcaaattataaaacacaagattatacgcaagtattattgatggtagatagctttttacatcaatttacacaaagcccaaatcaagcctatgcggtatatatggctggcttaactaatgcagcaacaggcgataatttcattcaagatttttttggaattgaccgtgctacacgtgaaacaacctctatgcgtaccgctttttctaatttccaaaacttagttcgtgtattccctaatagcccttactcacaagatgctttagctcgtatggcttatattaaagatgcactggctcgtcacgaattagagattgcaaaattctatgcaaaacgtaaagcgtgggtagcagttgcaaatcgtgtggtaggaatgttaaaacaatatcctgatactaaagcaacttatgaaggattatttctgatgcaggaagcttatgaaaaaatgggtttaaccgcattagcaaatgatactcaaaaaattattgatgcgaataaagataaaacttttgcaccaattgaaaaaccaaacgagccagacttaaaagtgccagcagtaaaatagcaataactgcagaaaaatcgaatactctctgcaccctaaaaattgaataaaatttaaactaattaaggtgcagatttttttattttttatcaactgaaaatgctttaccataatttgcacaaataatctgagcagcattataaagcgttgtatcaggtgttaaacttaacgtatgtttcttttgctttttaggtgctgcccgcaaaccctgtccccaaaattcatcatagaaatcagttcgtatttgagttaaatgataatttgcacaattcaaaatcttatactgacgaacagaacgtgcataacgtttaggctcaggataaacatacaatcccctatctaaattcaccacagcatcaaaatgtacaatttgtggctcttggttatccacccagatcgattcactatcgatgtaataattcacattctttaccaaacgtatatatccgcttcgtacatcagtcggcggtgccagcttcacatcattttgttcagccttttggatttgagcagaacaagcggtaagtaacccaagtgataatgttaaaataatttttttcattatttactccttatgttagctgacatttattctagaattttacagtgtgtccataaccttctaggattgttttaatatgttctaaggattctttagttggcggtaatacattttcaagctcataatctaacccaagggttttccatttatgcacacctaatcgatgataaggaagaagttcaactttttcaatattggtcataccttcaataaactgacctaataaatgcacatcgtgatcgctatcagtataaccaggaaccacaacataacgaatccaggtatgttgattacgtttttgcaaatattttgcaaattcaagggtacgtttatttggcaccccaataagattttgatgaacttgatcattaagttcttttaaatcaagtaaaacaagatctgttacatctaataattcatcaataatatgatcataatgacgtacaaaaccatttgtatctaagcaagtattaatcccttcctctttacaagcacggaaccaatcgcgtacaaactctgcttgtaacacagcctcgccaccagatgctgtgacaccaccgccagtagcattcataaaatggcgataagtcacgacttctttcattaaatcttcgacactgatttctttaccaccttcaagatcccaagtatcacgattgtggcaatatttgcagcgcatcaagcagccttgcataaataaaataaaacgaatacctggcccatctacagtgccacaggattcaaaagagtgaattcgtccaagaactgacatacataaatttcctaaaattagatatagctaaattttaccaaagatttagtctataaaaaatgagcctgatttaaatcaggctcatacatattatgttcccgccaaagtgcggtcaaaaataaacatgtttttacattgactctgtgaaagttctagtaattacgtcttgttgttgctctttagttaaagagttaaaacgtactgcgtaacctgatacacggatagtcaattgtggatatttatccggattttccattgcatctaataacatttcacggtttaacacgttcacatttaagtgttggccaccttcaaccgttgcttcgtggtggaagtaaccatccattaagccagcaaggttgcgacgttgtgcttctgcatctttacctaaggcatttggtacgattgagaaggtataagaaataccatctttcgcgtaagcaaatggaagtttagctacagaagttaatgatgctaccgcacctttttggtcacgaccgtgcattgggttcgcacctggtccgaatggtgcaccagcacgacgaccatcaggggtgttacccgttttcttaccataaactacgttagaagtaatggttaatacagattgtgtaggcactgcattgcggtaagttttaagtttttgaattttcttcataaaacgttcaactaagtcacaagcgatgtcatcaacacggttatcattgttaccatattgtggatattcaccttcgatttcaaagtcgattgctacgttagttgcaacaacattgccatctttatctttgatgtcgccacgaactggtttaactttcgcatatttgattgctgaaagtgagtcagccgcaacagaaagacctgcgataccacaagccatagtacggtatacatcacgatcatgtaatgccattaatgcggcttcgtatgaatatttatcgtgcatatagtggattacgtttaaggcagtcacatattgttttgccaaccaatccataaagctatccatacgagtcattactgtatcgaaatctaatacttcatcagtaattggtgcagttttcggacctacttgcatacctaatttttcatcgataccgccgttgattgcgtataacaatgttttcgctaagtttgcacgtgcaccgaagaattgcatttgtttacccacaatcattggtgatacacaacatgcgattgcgtagtcatcgttgttgaagtctggacgcattaaatcatcgttttcgtattgaactgatgaggtatcaatcgatacttttgcacagaaacgtttgaagttttcaggtaattgttcagaccaaagaatggttaagtttggctctggagaagtacccatgttgtaaagggtgtgtaaaatacggaatgtatttttggttactaatgtacgaccatctaaacccatacctgcgatggtttcagttgcccacattgggtcaccagagaataattgatcgtattcaggtgtacgtaagaaacgaaccatacgaagtttcataactaagtggtcaactaattcttgcgcttcagtttcagtaatttttcctgcttttaaatcacgttcgatgtacacgtcaataaaggttgcggtacgaccgaatgacattgcagcaccattttgtgattttattgcagcaagataagcaaagtacatccattgaatggcttcttgagcattagttgctgggttagaaatatcataaccatagcttgctgccatttgttttaattgacctaatgcacggtgttgttctgcgatttcttcacgtaaacgaattgttgcttcaagatttacgccatcttctaaatctttttgtaaagaagagaattgtgcgtatttatctttcattaagaaatctacaccataaagtgctacacgacggtagtcaccgatgatacgaccacgaccataagcatctggaagaccagttaataccccagatttacggcaacgtaaaatatctggcgtgtaaacatcgaatacaccttggttatgtgttttacggtattcagtgaagatttttttcacttttggatcaagttcacgaccataaactttacaagaaccttccaccattttgataccaccgaatggcataatggcacgttttaaaggttcatcagtttgaagaccaacgattttttctaaatctttgttaatgtaaccaggtgcgtgagagataatggtagatggtgtatgttcatcaaaatctaatggcgcgtgagtacggttttcaattttaataccttccatcacagattcccaaagcttggttgttgcttcggttggacctgctaagaaagagtcatcgccttcataaggggtatagtttttttggataaagtcacgtacattgacattttcttgccaatcgccaccagcaaaaccagcccacgccaatttttgcatttcattaagttctgacatagtcatttcctttgttaattaataaataaatctttaatgtgttttggttaaataacgttggaatacaccaatacaaattgccccgccgacaatatttcccaacgttacagggattaaattcttcacgatgaaatggtacaaatctaaatctgcgtatttcatcggatcaacaccgatttgttgccaaaattcaggtgtactaaaatgtgcggtaataattcccatcggaatcataaacatattagccacacagtgttcaaatcctgacgcgacaaacaaaccaatcggcataatcataataaatgctttgtctgtaacagtcttaccagaataagacatccaaaccgccacacacaccataatgttacataaaatacctaggttaaaagcttcaaaccaagtgtgatgaattttatgttgggcggttgcaagaattgttaaaccccattggccatttgctgccattgtttgtccactaaaccaaataacagccgcaataaataaaccaccaacgaagttgcctaaatacaccacgatccaatttcgaatcatttgtgtcgtggtgattctaccgcctacacgggcgactaaagttaaagtagaagaagtgaataattcagatcctaaaatcaccaccataattacgcccaaggagaagactaatccacctactaacttggttaatccccaaggtgcgcctgcactagcagtttgtgttgtcgtgtaaaatacaaaggctaaggcaatacaagcaccggcactaataccggacataaacgataaaaatggacgtttatttgctttataagttgctgtattttctgcataatccgttgcttcaacaggtgtgagcgcaacagaagatagtttttgattttctgatgccataatcaaactccaactattgacattgaaaaagttgatgaaaatttaatacttttaacaagtttacgactacaaatacttctataattggtgctattttactctcctcccctttcattgcaaagaaaagcaaaaattatttcaacaaactttgatattttgcaaggtttgtttaattaaagacaaaattcccatattaatattcgctcaatttcatacattcagagtaagtaaagtacttaatttgaaacttgttttattcgcgtaataccgtgaattcccccagataatcatccacttttccaaaaccttgattattcacaacaggcaaattcataattttttcaaacgaaccagattaagtgtatagacttgctattttgagtaattaatagcattattttgatctttttgaagaaaaaggcgatctttgtcataaaataatgatttaagtgcggttaaaatttggttaattttaagtgcacttctttatacaggagcagattatgtattatggtttagatattggtggcacgaaaatagagcttgccgtattcaatgaaaaattggaaaaattatattctgaacgggtgccaacacctaaaaccgactatgaagaatggcttaacacgattgtggatttagtgaatcgtgctgatgaaaagtttggtgaggtgggcaccgtaggtttgggcgtacctggttttgttaatcaacaaactggattagccgaaattgccaatattcgtgtggcagataataaaccaattttatgcgatttgtctacgcgtttgggccgtgaagtgcgggcagaaaatgacgcaaattgttttgcgttatctgaagcatgggatacggaaaatcagcaatattcgactgtacttggtttaattcttgggactggttttggtggtggctttgtcttaaacggtaaagttcattcaggtcaagtgggaatggcgggagagcttggtcatttacaattaaattatcatgctttgaaattattgggatgggataacgccccaatttatcaatgcggttgcggcaacaaggcttgtttggataattatctgtctggtcgcggttttgaaatgctttatcaagatttgaaaggcgaaacattatctgctcgtaaaattattaatttgttctatcaaagcaatgaaagtgcggtagattttgtgaatctttttgttgagttggcggcgatttctattggcaatatcattacggcatttgatccgcatatgattgtgttaggtggtggattatctaattttgattacctttatgaggctttaccaaaagcncttccgcctcatttgatgcgaaaagcaaaagttccgccaattaaaaaagcgaaacacggcgattctggtggtgtgcgtggtgcggcagcgttgtttttaaccaaataattcaacaaactagtggggcgtattcaaataatacgccctttattttggaaaatatttagaatattgtgaatttattagattttttcttgtttgtgtttctttctttagagaaattattaaaaaatctcgccttttcattgaaaagccatacaatcaaattatttatcgcttgagggatgattatggaatttgaattttcaaaaatgttagaagaagtgctaacttggatagtcgcacaccttgatggacctttatgggatgccaccattattattttgcttgggactggtctattttttaccattacaacaggatttgtgcagttccgtttattcccagcaagccttcgtgaaatgtggtttggtcgttcggtggaggggagttcattaacacctttccaagcgtttacaacaggtcttgcgagccgcgttggtgtgggtaacattggtggggttgcaacggcaatcgccttagggggcgaaggcgcagtgttttggatgtgggtaacggcatttattggtatgtcgagtgctttcgctgaatctacccttgctcaattatttaaaattcaagataaagatggatcattccgtggcggccctgcttattatattgtgcaaggtttaaaatcacgttgtatggcagtggcttttgcgcttgcattaatttttacatttggttttgcctttaattctgtgcaggcaaactctattgttgaagcaaccagcaatgcgtggaattggaaaggggaatatgtcggtatttcattagtaatttttaccgcacttattattttcggtggcgttaagcgtattgcgattatttcgagcaaccttgtaccaatgatggcacttttctatttgattatggcggtaattattcttggcatgcatattgatatgatcccttccgtgattcatcgtattgttcaaagtgcatttagttttgatgctgccgctggcggaatgtttggtgcattggtatcgaaagcaatgatgatggggattaaacgtggtttattctcaaacgaagcagggatgggatctgcgcctaattcggctgcagcagctcacgttaagcatccagttagccaaggtttagtgcaaatgctcggggtgtttgttgatacaatgatcgtttgtacttgtactgccgttattattttgctttcgaataattatggtagcgaaacgctcaaaagtatctctcttacgcaaaatgctttgcaataccacataggtgaatttggggcgcatttcctggcgtttatcttattgttattcgcttattcttctattattggtaactatgcttatgcggaaagcaacatccgttttatcaagaataaaccttggttggtcttgttgttccgtttaatggtgctatttttcgtgtatttcggtgcggttcgctctggtaatgtggtgtggaatttcgcagatacggtgatggctgtcatggcaatcattaacttgatcgcaattttgatgttgtcgccaatcgtatggaaattaatgaaagattatcaacgccagcttaaagaaggaaaaacgccagagtttaaaattgatgaataccctgaattacgtaagaaaatatttgattcccgcatttggaaataaagataaaatggctagaaagagattatctacctttccaaaaagagttagattattatttaaagaaattttttgatattgtttcaggcttggttcttctagttcagactgaataaactattgccggcactttttaccgccctcgtgccggctatcccaaactgctttgaaaactgaccgctctttagcttacttcaaaaattccgcatgataggcaatatgctcgccaataaaactggcgatgaagtaatagctgtgatcatagcctttatggaagcgcacatcgactggctgatttgccactcgacaggtttctataaaatcttcggtacgcaattgtgtcggtaaaaactcatcttccaagccctgatcaatgcgcataccttgcactttatagccttgttgaatgagcgagctggcatcatattgctgccatttttcacgatcttcccctaaataggcagaaaaggctttttctccccaaggcacaaggcttggcgacaaaatgggcgaaaaggcagaaacgctttgataacgttcccgatttcgcagtgccaataccaatgcaccgtgtccacccattgaatgtcccataatggaacgtttgccgttggtagggaaatttgcttcaatcaaatcaggcaattcattcaagatataatcatacatttgataattcgtcgcccaaggctgctcggtcgcattaagataaaagcccgctccctgccctaaatcgtaagccgcatcattcggcacttgctctccacgagggcttgtatcgggagcaacaacaatcacttgatgttctgccgcgtaacgctggaagcctgatttggtaatgaaattttgctcagtacaagttaagcctgaaagccaataaatcacaccaagcggtcgattttctggattatttggcaaataaacggcaaatttcatttcacattgaagtgtttgagcattatgcgcccaaacttgctgcgaaccgccaaaaatttgatgttgttcaattagtttcatagcgtaccttagtagtgaataacagtacggattgatttaccttcgtgcattaattcaaaggcttcattaattttatcaagtggcattgtgtgagtcacaaacggttctaactggatgtcgcctttcattgaatcttccaccatttgcggaagttcagagcgacctttcacgccaccaaatgccgaacctttccaaacacggcctgttaccaattggaacggacgcgttgaaatttcttgtcctgcacccgctacgccgatgataatggattgtccccagccacggtgagcactttctaatgcttgacgcattacgtttacattaccgatacattcaaaggtatggtcaatgccccatttattaatatctaacaacacatctttgatcggcttatcgtaatcattagggtttaaacaatccgttgcaccaaactgttttgccaactcaaattttgcaggattggtatcaatagcgataatgcgacctgctttggcttgacgcgcaccttgcactaccgctaaaccaatcgcacccaagccaaacacggcaacagagtcgccttcttgtacttttgctgtattatgcaccgcaccaatacctgtagtgacaccgcagccgagcaaacacacttgttcgtggttcgcttcagggttgattttcgccagtgaaacttccgcaacaactgagtattcactgaaggttgaacagcccatatagtgatagatcggctgaccttgataagaaaaacgtgtcgtgcaatcaggcattaagcctttaccttgcgtgtcacgcactgagacgcataagttggttttacccgagcggcaaaactcacattcgccacattcagctgtataaagaggaatgacgtgatcgcccggttttacgcttaacacaccttcgccaaccgcaacaaccacacccgcaccttcgtgtcctagcaccacagggaataccccttcaggatcgcttcctgataacgtaaacgcatcagtatggcaaacgcccgtgtgagtgttgcggattaacacttcacctttgcgtggcatttctacgtcgatttctacaatttgtaagggttgatttggggcgaatgctaccgccgcacgagatttgatggttgaattgatttgtttaatttccattgtttttcctcttaattcattgacaaagttgccttacgtaagcaagatagcaacagtttacactttagagttcactctaaagcaagtgtttttttatcatttttgtttaaagggaataaaaagtgacttacaccaccgctaaagctgctgaaaaaataggcatttccgcctacaccttacgcttttatgacaaagaaggcttgttacctaatgtcggacgtgatgaatacggtaatcgccgttttaccgacaaggatttgcaatggttgagtttattacaatgcttgaaaaatacaggaatgagcttaaaagacatcaaacgctttgcggaatgtaccatcattggcgacgatactattgaagaacgcctttccttatttgaaaatcaaacaaaaaatgtaaagtgtcaaattgccgaattaaaacgttatttagatttgcttgaatacaaattagcgttttaccaaaaagcgaaagcactaggctcggtaaaagctgtgaatttaccgcaaattcctgaaacgagctaaaagggtaaaagtgttcacatcacagaattagaagaaaaatacaatttttagagatagataaattttaacttttttattacataaataagttaaaaatcaggttttgtgatcaagatcaggataacataaaaataatctccgatagctattgttctaaatggctaaaaagagtatattccgagccaaattttttcttttttacagaacggagtttattatgtttggtttatcccccgctcaactgattattttattagtcgttattttattgatttttggcacgaaaaaattaagaaatgctggctcagatcttggtgcagcagtgaaaggtttcaaaaaggcgatgaaagaagatgaaaaagtaaaagatgcggaatttaagtctatagataatgaaacagcgtctgcaaaaaaaggaaaatataaaagagaaaggaacaggcttaatccgtgtttgatattggtttttcagaacttattttactaatggttttgggattggttgtattaggcccgaaacgtttgcctatagcaattcgcactgtaatggattgggtaaaaacaattcgtggtttagctgctaacgttcaaaatgagttgaaacaagagctaaaattgcaagaattacaagatagtattaaaaaagcggaatcccttaacttgcaagccctttcaccagaattgagtaaaacggtggaagaattaaaagctcaagcagataagatgaaagcggagctagaagataaagcagctcaagctggtacaacggtggaagatcaaatcaaagaaatcaaaagtgcggctgaaaatgcagaaaagtctcaaaatgcaatctcagttgaggaggctgcagaaactttatctgaagcagaaagaacacctacagatttgaccgcacttgaaactcacgagaaagtagaactgaacacacatttatctagctattatcctcctgatgatattgaaatcgctccagcgtcaaaatctcaatcttcaaaaactaaatcatagcgagtttttatgagtaatgtggatgaatctcaacctttaattacgcaccttgttgaactaagaaaccgtttattacgctgtgtgatttgtgtagtgttggtttttgttgctttggtgtatttttccaatgatatttatcattttgttgctgcacctttaacggctgttatgccaaaaggcgcaacaatgattgcaaccaatattcaaacgcctttctttacgccaattaaattaactgcgattgttgcaatttttatttctgtcccttatttgctttatcaaatttgggcttttattgcacctgctttatatcagcacgaaaaacggatgatttatccgttgttattttccagtacgattttattttattgcggtgttgcttttgcttactatatcgtctttcctcttgtattcagcttctttacacaaacagccccagaaggcgttaccatcgcaacagatattagtagttatttagattttgctttagcgttatttttagcttttggcgtttgttttgaagtgccaattgcgattattctactttgctggactggtattaccactgtaaaggctctttccgaaaaacgcccttatattattgttgcggcattttttattggtatgcttttaacgcctcctgatgttttttcacaaactttgcttgccataccgatgtgcttgctgtttgagctcggtctattggtcgctcgattttatcaaccaaaagacgacgaaagtgcggttaaaaataatgatgaatcagaaaaaacacaatgatgaactgaattgttaatcgtatgggggctttgcccccgtttttattatattgatataaccctaattttgttttttcataaaacatattttcgtagtgatttactagaaatatgatttgtaatctgctctatatttttattgaaaatatcattacctgatggttttctgtcgttttttattttttatctaataaatacgatattttttagataatttctttactttttccttttctttaaatttcctttataaaaatggttgcaagattaaattagccattgcatattgtctatgcgcctcacgaggcgaatacaataaaaatacaatacacacaacatcaacaaagagggaaattcattatgtcaaaagttgcttccttagacgcatttttaacaaaagttgctcaacgcgatggttatcaacctgaatttttacaagcggttcgcgaggtattcacatcaatttggccttttttagaagccaatcctaaatatcgttcagaagcattattagaacgtttagttgagcctgaacgtgcatttcaattccgtgtggcgtggactgacgataaagggcaagtgcaagtaaacagagcatttcgtgtacaatttaatagtgccataggcccatttaaagggggaatgcgtttccatccatcagtaaatttatctatcttaaaattcttaggttttgagcaaatctttaaaaatgctttaacaacattgcctatgggcggggcaaaaggcggttcagattttgatcctaaaggcaaatctgatgctgaagttatgcgtttttgccaagcattaatggctgaactttatcgtcacgtaggagctgatacagatgttcccgcaggcgatataggcgtcggtgggcgcgaagttggctatttagctggctatatgaaaaaattatcaaaccaatcagcctgtgttttcactggtcgcggtctttctttcggtggtagtttaattcgtccggaagcaacgggatatggattaatttattttgctcaagcaatgcttgctgaaaaaggcgatagttttgcaggtaaagtagtttcagtttctggttctggtaatgtagcacaatatgctattgaaaaagcattatctcttggtgcaaaagtagtaacttgttctgattcatcaggttatgtttatgatccaaatggatttactactgaaaaattagccgcacttttcgatattaaaaatacaaaacgtgggcgtgtgaaagattatgcagaacagtttggtttgcaatattttgaaggtaaacgcccttgggaagtgcaagttgatattgcgcttccttgtgcaactcaaaatgaattagaactttctgatgcacaacgtttaattaaaaatggtgtgaaattagtggctgaaggtgcgaatatgccaacaacaattgaagcaacagaagcattactagctgcagatgtattatttggcccgggtaaagctgccaacgctggtggtgttgctacttctggtttagaaatggcacaaagttcacaacgtttatattggacagcggaagaagtggacgctcaattacatcgcattatgttagatattcacgcaaactgtaaaaaatacggcacaattgaaggtcaagaaaacattaactatgttgttggggcaaatgtagcaggctttgttaaggtggctgatgcaatgttagcccaaggcgtttattaacaaataaaaaagttaaactaaataaccgcactgtaataaagtgcggttatttttttaggatgaaatttgaatataagaaagcgacattttgtcgccttagatattatttattttgaattgttttcgtcacaatgattaatatcactgcatttgccgtaaagatacacgttatgcgtttttaattttatgccgtatttttcactgatttcacgctgacgttgttcaataatattatccgtaaattcaaatactttaccgcaatcttcacaaataatatgatcgtgatgttctgttggagcaagctcaaaaacggatttatttccctcaaaattatgacggattacaatatgcgcttcatcaaattgattaagcacacgataaactgtggctaatccaatttcacaaccttgttccaggaaaattttataaacatcttctgcagaaaaatgttcatttttatgattttgcattaaagcgagaatagttaagcgaggctctgtaatttttaatcccacttttttgagtaatttaatatttccttcagacataattttccttcctattatgcacaaaatgctaagccaattcagctaagcacatttcatcataaatttgtttacaccatttttctacacgctctgcggtaagctctggttggcgatcttcatcaatacataatccgatgaaagtgccatcttccaataaggctttcgaagcttcaaaattatagccttctgttggccaatttcctaccacaattgcaccgtgtggctctataatatcgcgcacagttccgatagcatcacagaaataatctgcataatcttcttgatcgccacaaccgaaaatacctacaagtttatctgtaaaatcaatttcttcgagtgttgggaaaaagtcatcccagtctgcttgtgcttcgccgtaataccaagttgggataccgaaaagcaagaaatcgtatgcttcaatatcttctttgctacttttggcaatatcacgaatatcaattaaatcactacctaattgtttttggatttgttttgcgatgttttcagtatttccagtatcactaccataaaaaagaccaactattgccatttttatttccttttttatattaaatttaatctattgattataaggcttatccaaatttggcgaactatatcataaaagcattctcacttaaactacttaattcttatttagaaatcgtttaattgcacgaataacaaaatcaggtttttcggcgtgaacccagtgtccactgccattaatcgtaaaggcagttgcattaggaaattgttctagaattttttcgctattttctatttttatataagaggaatttccacccttaataaaaagagttggcgtaaatacacgtactttttcccaatccataatattggcataattgttaaaaagcgcggtaagattaaaacgaaaacaatcagctgaattaacatcaaaagatttcaacataaattgtacaacgtcttcatcattaatttcttgttttaaaatcggtttggcttgctgacgattttcaggctttgcattttttaccgcaaataggccattaaaaacatctttatgaccaaatccctcataaggcataggcgacatatcaattacgattaatttttcgactaattctgggcaaagtgcggtgattttcatggcggtttttccccccatagaatgaccaattaatatcactttggataaatttaagtggcggattactgcgataacatcttcagccatcagttgataattcattttttccgaatgaaaactatggccgtgattgcgtaaatcaatacgtaaaatactgtaatgttcactaaaagctctcgcgataacgccgagattatccatatcgccgaataaaccgtgaataaaaattaaaacaggtgtattaatcgtttgttttacttgatgaaattgataattgagtaatgattttgccataatttttacgtgagaatttgtaaagaagtcgttataattgaaaaaaattttagcaaacagagagataaaaatgaagatcattgaagtagatgaagaattataccaatatattgcgagccaaacccgctctattggagaaagtgcttcggatattttacgccgtttgcttagtttacctgtgcatacttcaattgttaatgatttaattattacttcagcagaaacagatcaaaagccaaaacaggctatcaatgtgaaagaagtaaatatcaaaacaacaaaaaagcaatcaataaccgcaattaatcagattgtagaaaaagtccaaactttattaaattcaactgaatttcaagaagaaagtaaggctgttgtacgtttcttagcgattttacgtgtgctttatcgtacaaatcctgaaagttttgcgcaagcaacggaatctttacaaggacgtactcgagtttactttgcacgcgatgaagcgacattattaatggcaggtaaccatactaaaccaaaacaaattccagatacgccttattgggttattaccaatacaaatagtggacgaaaaatgttaatgctagaaggtgcaatgcaatctatggaattacctgaaacattgattgatgaagtgcgatcatatttcacggtaaattaataatgtatccttggcaagattttgctattcaacctgatttctcagataaaatcgctttgcgtactacgcagggcgatatgcttacttggatagaattgactacaaagattaaccaaacagtggcttttttacaaaaaaaaggcgtaaatgcagaaagtgcggttgcttttgtgggaaaaaattcagagaaaattttatttttatatctggcgacaattcagcttggcgcaaaagttttaggcataaaccctgcttttccacaagaaaaaattgcaaaattatgtgagttttatcaaattgatttttgtttttatgataaagatttactgaatttgcaagaaattgatgtttttactcaaaaagccgatttttttcgtcctgcgacgatgacgctaacgtctggctcgacaggtttaccaaaagcagttgtgcataatgtccaagcacatttggataatgcaaaaggggtatgtaacttaatgaagtttgattgtaatcaatcttggttactttcattacccttatatcacgtttcagggcaaggtattgtttggcgttggttatattgcggtgcacaattacatttcccagaagatgatttttatgcttcattattaaagacgacccacgtttctcttgtgccaacgcaattacagcgtttattagattatttacaggaaaatccgagcatttcatttgctacacgccatattttactgggcggtgcgcatattccgacagaacttacacaaaatatgttgaaatatggtatcgaaacgtattctggctacggaatgacggaaatggcttcgacagtttttgctaaaaaatctgacagaaaacaaggcgtagggcaaccgctcttaggtagagagtattgtttagtaaatgatgaaatttggctgaaaggtgcaggtttggcgatgggttattggaaagatcgacaaattgttccattaacgaataaccaaggctggattcagacaaaagataaaggcatttggcaagagggcgaacttgttattatcggacgacttgataatatgtttatttcaggtggcgaaaatattcagccagaagaaattgaacaagtgattattcaacattcttcagttaatcaagtatttgttttaccacaaaaaaacaaagaatttggtcagcgtcctgtcgctttagtggattttaatgagccctttagcaaaagtgcggttgaaaatttaatgttttttttacaagataaacttgcacgttttaaacaacctattgcatattatcctttgccactgatgcttgagaaaggcattaagatctcacgtaaacagcttgctgattggttggcaaagcgagatgagataaattaatttaccatttagattagggaaaaataatgattaggaaacttatgaaaatacctccattttttaccgcactttttgcctcggcaatgtttacccttagcgtttcgcaaggggtattggcggcaaattcaacaaatgtattaccaacggagcaatcgcttaaagccgatttggctaacgctcaaaaaatgagtgagggggaggcaaaaaataggttgttagcagaattacaaacatcaattgatttattgcagcaaattcaagcccaacaaaaaatcaatgatgcattgcaaacaacattaagccattcagagagtgaaattagaaagaataatgcagaaattcaagcattaaaaaaacaacaagaaacggcaacaagtactgatgataatgcgcaatcacaggactatttacaaaatagtctcactaagttaaatgatcaattacaagatacgcaaaacgcattaagcacagcaaatgcacaattggcagggcaaagttctatttctgaacgagcacaagcggcattaacagaaaatgttgtacgcacacagcaaatcaatcaacaattagccaataatgatattggtagcacattgcgaaaacaatatcagattgatttacaactgattgatttaaagaatagttataatcaaaacttattaaaaaataatgatcagctttctttactctatcaaagccgatataacctattgaatttacgtttgcaagtacagcagcaaaatattattgcgattcaagaagtcattaatcaaaaaaatcttcagcaatcacaaaatcaagtagaacaagctcagcaacagcaaaaaactgtgcaaaatgattacattcaaaaagaacttgatcgcaatgcacagcttggtcagtatttattacaacaaacagaaaaagcgaattcattaactcaagatgagttaagaatgcggaatattttagatagcctcactcaaactcaacgtactattgatgaacaaattagtgcattacaaggcacgttagttctttcacgtattatccagcaacaaaaacaaaaattaccgactaacttaaatattcaaggtttatcaaaacaaattgccgatttgcgtgtacatatttttgacattactcaaaaacgcaatgaactttatgatctagataactatattaataaagttgaaagtgaagatggaaaacaatttactgaggcagaaagaacgcaagttaaaacgctattaactgagcgtcggaaaatgacatctgatctgattaaatctttaaataatcaattaaatctcgcgatttctttggaattaacacagctgcaaattacacaaatcagtgatcaaattcaatctaaattagagcagcaaagtttttgggtgaaaagtaataatcctattaatttagattgggtaaaaatgctgccaagagctttaattgaacagtttaatggtatgttgaaaaaattaggttttccaactaattatgacaatttaccttatttgctgatgtatttcttagggttatttattgtaggcggtgcaatttttaaatttaaaaatcgtattaaacaacaattaaacaaaattaatcgtgaaatacatcgtttagatacagatagtcagtggagtactccacttgccctgttattaacagcgtttttaacgctttctagtacactttggtttttagcagtttgccaaatgatcggcttctttttcttcaaaaatccagaagaattttggcattggtcatttagtatggcgggttattggtggttctttacattttggatttcattgttccgtccaaatggtatttttgttaatcattttgaatcttcaaaagagaatgcacaacgttttcgtggtgttatccagcgcattattgttgtggttgtattgcttttaaatacttctgtgtttagcaatgtcactgatgcaggtttagctaatgatgtgttaggtcaaattaatactattgcggctctaattttctgtgcggcgattattgcccctcgttttaatcgagtacttcgctcttatgaacctgaaacaaataaacatcattggttaataagaattgtacaaattggttttagattaattcctgtgggattaatcgtacttattgttttaggctattactacaccgctttaaatttaattgagcattttattcattcttatattgcttggtgtgtatggtggttagtacgcaatacgatttaccgtggtattacggtttcttctcgtcgtttagcacatcgccgtttagcagaaaaacgtcgtcaaaaagcacttgaaaataattatgaaaatatatcctctgatgatgtggttgcagtgggagagccagaggaaagtttggcgttaaatgatgtgcgtagccaattattacgttttgtagatctctttatttggacagcattattagggatcttctactatgtatggtcagatttagtcaccgtagtgagctatttacgtgaaattacactttggcaacaaaccacgacaaccgatgctggcactgtaatggaaagcattactttatttaatcttcttgttgctttggttatcgtaggaattacttatgtgttggttcgtaatatttcaggcattttggaagtattaattttttctcgcgtgaatctttcacaaggtacgccttatacgattacgacactacttacttatatttttatcgccattggtggtgcgtgggcatttgcaaccttagggatgtcttggtcaaaattacaatggttattcgccgcactttctgttggtcttggttttggtatgcaagagatttttgcaaactttgtgtcaggtatcattttgttatttgaacgcccaatccgagttggcgatgtggttaccattaatgaagtgagcggtactgtagcgaaaattcgtatccgtgcaattacattgattgattttgatcgcaaagaagtgattgtgccaaataaatcttttgtgactggtcaagtgaccaactgggcattatctaacactatgacacgtttagtgattagcgttggtgttgcttatggttctgatttaacactcgtgcgccaattattacttcaagcagctgatgaacaaccgactattttacgcgatcctaaaccatctgcttattttttaacttttggtgcaagtacactggatcacgagttacgtgtttatgtagaacaagttggggatcgcaccagtactacagatgcccttaatcgccgtattaatgaattatttgcagaacataatattgatattgcctttaatcaattagatgtatttatcaaaaataatgatacaggcgaagaaattccttttgttgatgtaaaaaaataagggcaaattatggctggtaatacaattggacaacttttccgtgtgacaacctttggagagtcacatggtattgcattaggctgtatcgttgatggcgtgccaccaaatctcgaattatccgagaaagatattcagccagatttagatcgtcgtaaaccaggaacatctcgatatacgacgcctcgtcgtgaagatgacgaagttcaaattttatctggtgtgtttgaaggaaaaaccacaggcacaagtattgggatgatcattaaaaatggagatcagcgttcgcaagattatggtgacattaaagatcgtttccgcccaggtcatgcggattttacctatcagcaaaagtatggaatccgtgattatcgtggcggtgggcgttcgtcagcacgtgaaacagcgatgcgggttgctgcaggggctattgcgaaaaaatatttacgcgaacattttggcattgaggtgcgaggttttttaagccaaatcggtaatataaaaattgctccgcagaaagtgggacaaattgattgggaaaaggtaaacagtaatccattcttttgtcctgatgaaagtgcggtagaaaaattcgatgaattgatccgtgaacttaaaaaagaaggagattctattggcgcaaaacttactgttattgcagaaaatgtacctgtaggattgggcgagccagtatttgaccgtttagatgccgatcttgctcacgcattaatgggaattaatgcagtaaaaggtgtagaaattggcgatggctttgctgtggttgaacaacgaggttcggaacatcgtgatgaaatgacacctaatggctttgaaagtaatcatgcaggcggtattttaggcggaattagttcaggacaaccaattatcgccactattgcactaaaaccaacttcaagcattacgattcctggtcgttcaatcaatcttaatggtgaagccgtagaagttgtaacaaaaggtcgtcacgatccttgtgtggggattcgtgctgtgccaattgcggaagctatggtggcgattgtcttattagatcatctcttacgttttaaggcacagtgtaaataatcctgtacctagggtagtatactctaggttagttcttcaataggactgaacctaggatatacttacctacagcaaaactttagaatgaataaaattttattaaaaacaaccataatttttaccgcacttttctctctgaacgttgttgcgtctcctctagattggcaaaaagtgaaacgccctattccaagtgaagatggtaaagcaagtcctattggtagttataccaacgggtgtattattggagcacaagcattaccgccgaaaggtgaaggttaccaagtgattcgcatgaatcgcaatcgttattatggtcatccaaatatgattcagtatcttgaacgtttggggcagcgagctaaagctgctgggttgccaacgatgttagtaggcgatattgccatgcccggtggtgggcggtttttaacgggtcatgctagccatcagatgggattagatgcggatatttggttaagaatgggcgaaatgtcagatgccgatgcgctcaattctgatggtaaaggtttattagttgtggatagaaaggcgcaacgagtagatgagcgcgtgtggaatagcaatcatgcgacgttaatcaagttagctgcgcaagatccaaatgtgacgcgtatttttgttaatcctgcgattaaggtaaaattatgtcaaaccgctggcaatgatcgcggttggctacacaaaattcgtccttggcatggacacaactctcattttcatgttcgtttaacttgcccagcagatgcatcttattgtgaaaatcaagcgcctgtgcctgctggtgatggttgtggagacgaattatattcttggtttgaaccgccaaaaccaggcacttcagtgagcaaacctaaagttacaccgcctgagccgtttttgtgccaacagattttgaactcaccgaatcggagagaatggttagaatagcattgaggtaaatcaatatggatatcggcattgatcttttagcaatattgttttgtgttggttttgtcgcatcatttatcgatgcaattgctggcggtggtggattaatcaccattccagcgttactcatgacaggtatgccaccagcaatggcgttaggcaccaacaaattgcaagctatgggcggtgcattatccgcaagcctttatttcttgcgaaaaagagcggtcaatttacgcgatatttggtttattttgatttgggttttcttaggttctgccctaggtacattattaattcaatcaattgacgtggcgattttcaaaaaaatgcttccttttttgattttagccattggtctatatttttaatttactcctaaattaggtgatgaagatcgaaaacaacgattaagttatctgttatttggtcttttagttagcccatttttaggtttttatgatggcttctttgggccagggactggctcaatcatgagtttagcctgtgttactttgctaggatttaatctcccgaaagcggcagcacatgcaaaagtgatgaacttcacttcgaaccttgcttcttttgcacttttcttattgggcggacaaattctttggaaagtgggtttcgtgatgatggctgggagcattttaggtgcaaatttaggtgccaaaatggtgatgacgaaaggtaaaaccttgattcgaccgatggttgttatcatgtcttttatgatgacggctaaaatggtttacgatcagggttggtttcatttttaattcggaaagcgcgcaaaagtgcggttaaaattaattacattttattatgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaattgacgggaaaattaggtatttggattgggcataaagcaaagaaacagcgtacgcgtgcacaaactaacttgcaatattgtttccctcattggactgaacaacaacgtgagcaagtgattgataaaatgtttgcggttgtcgctcaggttatgtttggtattggtgagattgccatccgttcaaagaaacatttgcaaaaacgcagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtggattggctttggacgattacacgccaacgtttcggcggaaaaatgcatgcacgccaaaatggtattaaaccttttttaagtcatgttcgtaaaggcgaaatgggttattacttacccgatgaagattttggggcggaacaaagcgtatttgttgatttctttgggacttataaagcgacattaccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacgccagcgccagagcaatatgtttggattttgcaattattgcgtacaaggaaagatggcgaagatctttatgattaaaaatagggtttgaaagtcatattctcgaaaacggatattcaataaggtaaataagaaatggaagaaaaaattcggctgacgcaatacagccatggtgcaggttgaggctgtaaaatttcgcctaaggtgttagggacaattttacattcagaactggaaaaattttatgawccaaatctgatcgttggcaatgaaactgcagacgatgcggcggtgtatgatcttggtaatggaactgcaattatcagtaccacagactttttcatgccgattgtggatgatccttttgattttggacgaattgctgcgaccaatgccatcagtgatatttttgctatgggcggtaagccgataatgggaattgctattttaggttttccaaccaatgtattacctgcagaagttgcacagaaaattgttgatggtgggcgttttgcttgccatcaagcggggattgctttggcgggtggacattccattgattcgcctgaacctatttttggtttagccgtgacaggcgtgattgacactgaaaaagtgaaacgtaatgcttctgcaaaatcaggttgtaagctttatatgacgaaaccgcttggtattggtattttgacgacggcggaaaaaaaaggaaaactaaaaccagaacatcaaggtttagccactgccgctatgtgccaaatgaattctattggtagtcaattttcccaagtggatggcgtcaccgcaatgacggatgtcactggatttggtttacttggtcatttaattgaaatctgtgaaggttcaaatctaagtgcggtagttttttcggacaaaattaaaaccttggacggtgtaaaagattatattgctcaaggttgcgtaccgggtggaacagggcgtaattttgacagttatggacataaagttgggatattgacggaagaacaaaaagcgattttgtgtgatcctcaaacatcaggcggcttattagtggcagttgagcttaatagcgttcaaacagtaattgacatagccaaagatgcggggattgatttatatgaagtgggtaaattgaaacctaaatcagaatccgatatcgttgttgaagtaaaataaggaattttaatcgatcctccctaatgattaattaaattaccatgatccacatagcaaaaaaccttggaatatcccaaggttttttagattatcattaaatataatgaattatgcgcctaaacgctctttaatacgagctgatttacctgaacgttcacgtaagtagtaaagtttagctttacgtaccgcacctttacgtttaactgcgatagaatctacagctggagagtgagtttggaatacacgctcaacgcctacgccgttagatactttacgtaaagtaaatgctgagtgcaagccacggttacgaattgcaataaccacgccttcgaatgcttgcaaacgacgtttgctaccttcaaccacccatactttaacttctaaagtatcacctgggcggaagctaggtacgttttgttttaattgttcttgttcaagttgtttgataatgttagacattgtttgatcctttattgatcctagatgtaactgaaactaactgttatgctcggcttgcgcctcttttaacagcttacgttgttcgtcagtcagagctaggccttctaagagctcagggcgtcggagccacgttctctgtagcgattgttttaatcgccatttccgaatttcttcgtgatgtcccgacatcagcacgggtggtacagttaatccttctaacacttctggtctagtgtaatgcgggcaatctaataaaccatctgcaaaagaatcttcttctgccgaggcttgtttgcctaatacaccgggaataaaacgtgcaacagcatcaattaatgtcattgccggcaattccccaccggtcagaacgtaatcgccgattgaccattcttcatcaatttcagtttgaatcaaccgttcatcaatcccttcgtaacgtccacatactaaaatcaatttctgattttgagcaagctcggttacgccgccttgatcgagtttacgtccttgtggcgaaaggtaaatcacctttgcgccttctcctgccgcagcttttgcagtatgaatcgcatcccgtaaaggttgcaccatcattagcattcctgggccaccaccataagggcgatcgtccacggttttatgcttgtcgaatgtaaaatctcttggattccaacattcaactttcagaagattatgttttacggctctacctgtaaccccaaattccgtaattgctttaaacatttcggggaataatgaaattacccctatccacataaaaagcctactacattacgtttgtgcatacttgagattagaaaccagcgtcccaatccacttcaatagttttcgtggtgagatcgactcttttaactacttgttcatacaaaaacggaattaaccgctcttgttttccaaaagcatctttggtattggctttaaccactaatacatcattagaacccgtttccatcatttctgttactgttcccattgtataaccttctaagtttacgactgtacaaccgattaaatcgtgccagtaataatcgccctcttctagttctgggaaaacagataaatctacaccaatttcaacattcgctaaaatttgtgcagcttcacggtcatcaacgccttttaatttaacgatgatttcgtgattatgataacgccagttttctaattcaattgattgccattcgcctttgatttttaaaaaccaaggttgataatcaaaaatgctttcagcttgttctgttgatgaataaatacgcaaccacccacgaataccgtaggttgagcctaatttgcccacaacttcaatatgttgttgttccatatttttcacctatcttagtttgagaactaaatcaaaaagcaaaattatgctgctttttgtgcttcttttaccaagctcgcaacacgatcagaaagtgaagcaccttgagcaacccagtgatttacacgctcaagattaatgcgaagacgttctgcattaccttgtgcaattggattgaagaaacctacacgttcaatgaagcgaccgtcacgaggtgaacgactgtcagcgactacgatttgataaaatgggcgttttttagctccgccacgagataaacgaatggttaccataaccttcctctaaatgtttaattactaaaagaatattctcaaattcgaaagtgatttgagaatatagcttacttttttctctgtatatatagacaaaaagcctgcgaattttatacttttcaagcaaaattgcaagttttgtatgcataaagtaggttgtattccttttaattatcattcacaatttattttgttttacgatataatacgaggcatccagctgttttaggtcaaatttacgcgtatagcggtattttagcttgataaaatatcagttaaatgaggtttatatatgaaaattagttttcattctgtgttaattggattagcatcatttattggtgttcaacaaggtgtaatagctaatccgtcttctcatcaatcaatatccactgaatcagctgaggctttgaagcaacaattttcaatggctttagctaaacaagataaacaacaaattacaaatttacaaaaaaaacttaccgcacttttttctttacctccccaatttcttgataatcagatccaaataagcgaaaaaancctcactcgcatttttaaaacagataaaaatctcacgcctaaatttcttgattacttatactttgagccaataaatactgttgatgctaatttaattcaggaaatgaagaaaaacttactggtgtcttttttagcaaatgatcaggcaaaaatttatattcgtcaaacagataattcagagcaatttgttcagactttaatggagcggggagcaaaagcagatcaaattatattactgtctttgaatgccaaaggtatatttcaaaaaattattgaacaaatacgtcaagattttccgaatcagactattttttcgattactgaaaatcgtattagtttgattactccttcttcagaaattaagtctcgccttgctttagcaaatatgatgttcaatcgccaatttaaaggtgtggaagttgatgatttctcatatttagatcaacctcgagaaaatttacagcacaataatgatgcaattcgttacaaaacctttcaagcaatgctagaaggtttaaattaatcccttaccaataggagtttttatgcttttatccaaaaaatcagcctcctttgcactcagtgcatttgcgatgcttttcactagtgtagctcttgccaaagaggcaccacaagctcacaaagctgtggaattaagtattttgcatatcaatgatcaccattcttatttagaaccgcacgaaacacggattaatttaaatggtcagcaaaccaaagtggatattggtggtttttctgctgtcaatgcaaaacttaacaaattgcgtaaaaaatacaaaaatccattagtactgcatgcaggcgatgccattactggtacactttacttcacgctgtttggtggttctgcagatgcagctgtgatgaatgcaggtaatttccattattttactttaggtaatcatgaatttgacgcgggtaatgaagggttattaaaactgcttgaaccattaaaaatcccagtgctttcagctaatgtgattcctgataaaaattcaattttgtataacaaatggaaaccttacgatattttcactgtggatggagaaaaaattgccattatcggtttagatactgtgaataaaacagtgaattcctcttctccgggtaaggatgtgaagttctacgatgaaattgctactgcacaaattatggcaaatgcgctaaaacagcaaggaattaataaaattatcctactttcacacgcaggtagtgaaaaaaatatcgaaattgctcaaaaagtaaatgatattgatgtgatcgttactggcgattcacattatttatacggaaatgatgaattacgtagtttaaaacttccagtaatctatgaatatccacttgaatttaaaaatccaaatggagaccctgtatttgtaatggaaggctgggcttattctgccgtggtgggggatttgggtgttaaattcagtcctgaaggtatagcgtctattactcgtaaaattcctcatgtgttaatgagttctcataaacttcaagtgaaaaatgcggaaggtaaatggacggaattaactggcgatgaacgtaaaaaagcacttgatactttaaaatcaatgaagagtatttcacttgatgatcatgatgcaaaaacagacatgcttatttcaaaatataaaagtgaaaaagatcgtttagcacaagaaattgttggtgtcatcacaggttctgcaatgccgggtggttcagcaaaccgtatcccaaataaagcaggctcaaatccagaaggttctattgcaacgcgttttattgcagaaacaatgtataacgaactcaaaacagtggatttaactattcaaaatgctggcggtgtacgcgcagatattttaccgggtaatgtaacctttaacgatgcttatactttcttacctttcgggaatacgttatatacctataaaatggaaggttcattagtgaaacaagtgcttgaagatgcaatgcaatttgctttggttgatggctctacaggcgcattcccttatggtgcaggtattcgttatgaagcgaatgaaacaccaaatgcggaaggtaagcgtttagtgagtgttgaagtcttgaataaacaaacccaacaatgggaaccgattgatgataacaaacgttatcttgtcggaacaaatgcttatgttgcaggcggtaaagacggttataaaacctttggtaaattatttaacgatccaaaatatgaaggcgttgatacctacttacctgatgcagaaagtttcataaaatttatgaaaaaacatccgcactttgaggcttacacttcatcaaatgtgaaatttaatgcttcaactgatgcattacctaaaaaataaaattgaaaaataggctaaaaatagcgcgtatttaacgcgctatttttgttattagtcctaggtttgaagacttcatagatgattaagaattttaactattccatatttagatgctttctcgtggaaaataaattccctatagaggttgaaaaatagggtgatttattgcgataatctaccccattttttgggagatctttctatcttctgcatttttacgcagtttattttcattagaaatgatcgaattttatttcacttttaatttaattagataaagaacaatggcggaaaaacgtaatatttttttagtaggaccaatgggtgcaggtaaaagtactatcggtcgtcaattagcacaacagcttaatatggattttattgattccgatgcagtgattgaagaacgtacgggcgcggatattagctggatttttgatttggaaggcgaagacggcttccgaaaacgtgaagaacgcattattaacgaactcacacaaatgcaaggtattgtactttcaactggtgggggagcagtgctttctaaggaaaaccgtaattatttatcagcacgtggtattgtgatttatttagaaacaacggtggaaaaacaattccaacgcactcaacgtgataaaaaacgtccattgctccaagatgcagagaatcctcgtcaagtattggaagatttagcaaaaattcgcaatccgctttatgaagaaattgcggacatcactttgccaaccgatgaacaaaatgccaaaataatggtaaatcaaattgttgatttaattgataatatgaatgggttgaatggtgcactttaaacacacctaaggataaattatgctgtgcgtcaacgtggaattgcaagagcgtcgctatcctattttaattggtagcggattgttacaagatgaacgtagttacccgattaaacgtggagatcgcgtgatgattgtaacgaatcccacggttgcacagttttatcttgatacagtcatctatgcgttggaaaaacgtggttgcgtagtcgatcatgttttattgccagatggcgaaaaatacaaaacacttgaatctttaaacttaattttcaccgcacttttgcaaggtaatcatgggcgagataccacgattattgcattgggcggtggcgtaattggcgatgttgctggctttgctgcggcaagttatcagcgcggcgtgcgtttaattcaaattccaacaacattgctttcacaagtggattcttcagtgggcggtaaaacggcggttaatcatgaattaggcaaaaatatgattggcgcgttctatcagccatcaatggttattattgatacgctcacgcttaatacacttcctaaacgtgaagtaaacgcggggcttgccgaagttatcaaatatggtgccattttagattacgaattttttgaatggctagagcaacatattgatgaacttgtcgctttgcatcctgaggcgcttcaacattgtatttctcgttgttgccaaattaaagcagatgttgtcgcgagagatgaaacagaaaaaggcgatcgtgcattgcttaatcttggacatacttttggacatgccattgaaactcacttaggttatggaaactggcttcatggtgaagctgtttctacgggaatgatgatggcagcggcgctttcggaagaacttggagatatttctattgcagatgtgtctcgccttgaaaaattacttgctcgtgccaatttgcccaccgtatctccagatacgatgcagccggaggactatttaccgcatatgatgcgtgataaaaaagttctatcgggtaaattgcgtctggtattactcaaatctctaggtcaagcttatgtggcgaatgataccgaacataccctcgtgttaaacgcaattcgtcgttgtactcaaacggattaagatgttacgtccgaaaaaacaatctttaaaacctaagttaaaacaccgtccatttttaaaatgggcggggggaaaatttcgtttaacggacgagataaataaagcctttccaaacaaaaaaaactgcttaattgagccatttgtgggcgctggagcagtatttcttaattctaattttgaacgctatattttggcagatatcaatcctgatttaatcaatctattcaatattgtgaaagnaaatgtagatggttatattgaagattgtaagccgattttcttcgctgatgatgccaatacacccgattattactatgctaaacgtcgccaattcaatgcatcaacagaacctttcgaacgttcgattatttttttgtatttgaatcgttttggttttaatggattatgccgttataacagcaagaatgaatttaatgtaccttttggtgcttacaaaactcattattttccagaggatgaattacgttattttgcgcataaagcgcaaagtgcggtgtttttatgctgtgattttcaaaaaacttttgaatttgccgataaggattcggtgatttattgtgatccaccttatgctccgctacaacaagagactaattttactggttatgcgggcaatgagtttggactggcgcagcaacgtgctttggcagatttagcgaaatctatacaaaaagaaaaacaaatttcgatattgatctcgaatcacgatactaaatttacgcgtgaaatttataacggtgctaaatttaaacgggtaaaagtccaacgttctattagccaaaacccagaaaaacgcgtaaaagtgaaagaattgattgcgatatttggtgctcgtaaataataaaaataacccttactttatactaaaagtaccaaaatcgtaattttaaaaccacaataaaataatatattatgtattaccatttatctcttacagtacctatatacttttttgatactaactcaaaatactcacaagtctgtaattttacctgtaatccttttgttttatcagaatgattatctagaaaactcatccaatcatcagaataattaacaaataattattatcctatagtagaatgtaaattattttaataacgccttatttgtactgtggataattcatcaaaatttaagcctgttatgctttattctttagtgtataacaaataggataaaaatggaaaaagcaaaaccatccaagcaaagaaattttaatcactgtcaaggagtacattattgaatttggtaataaaccgttaggtttaaaagatactacacccaaatgccactgccctatttgtgctcaagttttatttgagaaaaatgttaatacagtgccatcctctaatagcaatttttctaattacccaaaaagcgaattctgccccataaaattaaactaaagcaatttataccaatcatattttccattatcaccaaataaaacgcatggactgaattaaaaaatttattcagaaaaaattggcaaaaatattatcgtcaaattagttttttggcaaaaaacttataacctattgaatttattatattagctaatcaacaaaaaatttgggaatacgataaacttgaagagtatcaaattccttatattctattaacattagcagactgtcctaaccaaaaaggaacatataaaaataaacgtcactgctggtttagattttggtttgatgcttcaattcaaagatatgaagatatttggaataatagttctttaccagtattgtggacaacctattattacctatcagggaaacaaagaaaaccttcagaaataaatctaaaaaacatgaattatttcatcatggataaaactttcttagaacaagaaatattacttccccaatttattattcaaaatatagaacggtggtttaaaacacacaattttgtatagacaagtcagcacctaatactatttcatgacgaagatcgcctttttctttaaaaaggcaaaaataatgctattaatcaaccatgccagtaatgtcgccaccaacaaatctattgggtaatgcatgcctaatcgcacacggctaatcaacatcaataagccccacactgcaatacccaccaccagcaattttgctttaaaagaacggttacccaataattgggtaaagccaacagcaagcattagccaagttgctgcaaaaatcgtatgtccagaagggaacgaataccccgtttcattttcataatgatgaactaaccaagctggtgtaatggcatccatcgaataaaaattcttagctatttcagcacgcaaagtgcggtcatttttataaaagttttcaggcgttgaatgagtttgctcagctagataaacggtgaatggacgaggttcttcaaataatgcttttgcccctgtttttgcggcttgagttgcaataactgaaatccccatcacaattacgcctaatatccattgttttggatttttaaataaaaacgcaaacaaaagcgtaaacaacacacaggtgatcaacgcataaggtacgctacccgtttcagtgagcaaataaagccaataatcagcttgagttaattggctattaccatgccactgataggaaataccccaaataaaaaatggtacaagacaaagtaataacgtatataatgacagccttttgaacatgctcgccccttgataacaaaaataacgcgcgcattctaacagaaatgactacgaataaggatcactttatggcaaaaattcagctagttgcgcaagccaatttacccactgaatacggtattttcaaaatggtgggatttgaattcccagatacaaaaaaagaacatgtagccttagtgatgggcgatatttctaatgctgatgaacctgtattagcacgtatccattctgaatgtttaactggcgatgcgcttcacagcttaaaatgcgattgtgggttccaactggcgacagcattaaaacaaattcaagaagaaggtcgcggagtcttaatttatcatcgtgaagaaggtcgcggaattggtttgattaataaaatccgtgcttattctttacaagataaaggaatggataccattgaagctaatcttgctttaggtttcaaagcggatgaacgcaactttgaagtctgtgccgatatgtttgagctacttggtgtaaaaaaagttcgcttaatgaccaacaacccagaaaaagtagaaaccatgaaaaaagcaggtatcaacgtggttgaacgagtaccgcttaatgtaggcgaaaaccgctacaacacaaaatatcttgatacaaaagcgaaaaaaatggggcattacattgtgcataacaatgacgaacaacatttaatgacctgtccacattgccaggaagagattatttaacaaataagatatgtttaaaaagccatactgttatattgaacagtatggcttttttatttaaactttatgttatggaataatcaaaagattttttagcatattgctaaaaacgggaaaccccgtctcgtattccaaagatcggggcttatcaggagtaagtaaaatgaaaaaaattgcctttttcattttcttgattatctgttgtttagttagctgttccggaacagttatctaagataatcgcaaggggacgatgtaggagttgtccccaatgcctccaccaatcttaaagaattctttccttgattgcaagggcaattattgactttgaacctttctccacaaatctttactgtaaatgacaccgacagaatttacttgcgcacccattatactcggtacaagataaacaggcgtactatattgaaaaataggtaacactaaatgctcttgttgaactatcccttttaatttcgcgtaattttctaaccgcactttttcggatatcgtcgtcattgcactttcaaataaacgatcaaattccgcatttttatagccatttttgttatctgggctttttgaatagaataaatttagaaatgctgcaggatcattaaaatcagcacaccagccagaacgaattaattgaaaatcgccttttgtgcgggcggtttgcaattcttgccagctcatcccttgattttcaactcgtaataaatcagattgtgataattgatgatttaatcgcattgcaatggtttgattcagagataaatcatcataacgaatacgtaatttcaatggacgagtttcactaatttgattttgggaaaagagctgttctgcaacaactggctcccaaacagattcttgctcacctagcatagattttggcaaaaaagtattgttaggataaagatgagcaatatctgcaaccaaattattggtagaaatcatcgaaacaatcgcttttcttaccgcacttttttgtaacacaggatcggaaagattaaactcatagaagtaagtacaaagttgcggataatcttggatattctgattgacttttttcggattcattacaacatcaaaatcagacaaatctgcatcaacggaaattttttgatacttcacttgctgaaatatcactttttctttcgcccaataataaggattggtagttaaaatgtgctgattttcagcctgcctttgtaattgatatgcaccattgctgataaatatttcagtcgatttagcatagtgaggcaaaagactgacatgtgccagcatagaaggtaaatatggcgatgctttatctaattcaatgcgtaaagtgcggtcattttcggcaaacaatcctagggattcaacaggtaacgctttttccaatactgccttcgcatttttcagattcataaaagccaaataatttttaagtgggctttcagattgagaaagtgtttgccaagattgtacaaaatctgatgcagtgataggctcgccatttgaccatttagcattttcacgcaaagtgaaaatccaagttttattgtcttcggtttgccaattttctgctacagctggaacaagattaccctgcacatcataagctgttaatccttcaaaaagatctcgtaataattgagtttgttcttcgctttgtgcttgccaaggttgcaaagtcaaatcgctataaacgccacgttttaattcaactcggttagattccaattgagtatttttttgtgtctcaatttgtggcgaaataggcttaggactatccaatttatcacaagccaccaccgtaaaaataatagaaaaaataaccgcacttcgttggcacaaagcgaacaaattattcattttcggttttaatccaaaataagaagaaccaaaacttaatacaaatcaacgcaacaataacactacgccctattacacttggcgtgaaataaaaaccaattagtagcattgtggtaacaaaagtcaaaataaaaattttggtatttttctttaatgatcgattttcatgaaaggacttgagatgtttttgataaatacttgtgcctaaaaaccattgttctaagcgttttgaaccttttgtgaagaaaaataaagtaagtaataaaaaaggcgtggtaggcaaaagaggaaggaaaaatcccaatgatgccaattgcaagtgaaagaaaacctaaaataatgtaaataattttcataatgttcctaataaaaaaggaaaatgcaaactattattactgattttttagatttttcaaccttgatattatagaatttgccgtcacataaaaaaacagttttcaaaaaaggaacatttatgtctatgtcaaatccattacttaacattcaaggcctaccgccattttcacaaatcaagccagaacacattcgaccagctgttgaaaaattaattcaagattgtcgcaatacgatagaacaagtgttaaaacaaccgcactttacttgggaaaatttcattttgcctttaacggaaactaatgatcgcttaaatcgtgcttggtcgcccgtttctcatctcaattcagtaaaaaatagcactgaattacgtgaagcctatcaaacgtgcttgccgttactttctgaatacagcacttgggttggtcagcataaggggctttataatgcctatttagcgttaaaaaatagtgctgaatttgccgattattcgattgcacaaaagaaagccattgaaaattcactgcgtgattttgaactttcaggcattgggctttccgaagagaaacaacaacgttatggcgaaattgtggcacgcttatcggaattaaattcacaatttagcaataacgtattagatgccaccatgggttgggaaaaactcattgaaaacgaagcagaacttgctggtttacctgaatccgcactacaagctgcacaacaatctgccgaaagtaaaggattaaagggctatcgttttacgttagaaatcccaagttatttgcctgtgatgacttactgcgaaaatcgtgcattgcgtgaagaaatgtaccgtgcttatgcaacacgtgcctctgaacaaggccctaacgctggcaaatgggacaacagtaaagttatggaagaaattctgacgttacgcgttgaactggcaaaattactcggttttaatacttataccgaactttcacttgccacaaaaatggcagaaaacccacaacaagtgcttgatttcttagatcatcttgccgaacgtgccaaaccacaaggcgaaaaagaactgcaagaattgaaaggttactgcgaaaaagaatttggtgtcactgaacttgcaccttgggatattggtttttacagcgaaaaacaaaaacaacatttatacgccattaatgatgaagaacttcgcccatattttccagaaaatcgcgtgatttcaggattgtttgaattaattaaacgcatttttaatattcgtgcagtggaacgcaaaggtgtggatacttggcataaagatgtacgtttctttgatttaatcgatgaaaatgatcaactccgtggcagtttctatcttgatttatatgcacgcgaacacaaacgtggtggtgcgtggatggatgactgtatcggacgtaagcgtaaactggatggcagcattgaaacgcctgtggcttatttaacctgtaacttcaacgcaccgatagggaataaaccagcgttatttactcacaatgaagtcaccacgctattccacgaatttgggcacggaatccatcatatgctcacgcaaattgatgtatccgatgtggcgggaataaatggcgtgccttgggatgctgtggaattaccaagtcaatttatggaaaactggtgctgggaagaagaggctttggcgtttatttcaggacattacgaaacaggcgagccgttgccaaaagaaaaactcacgcaattgttaaaagcgaaaaatttccaagctgcgatgtttatcttacgtcagcttgaatttggtatttttgatttccgtttacatcacacctttgatgcggaaaaaaccaatcaaattttggatacacttaaatcagtgaaatcacaagttgccgtcataaaaggcgtagattgggcaagagcgccacacagcttcagccatatttttgcagggggctacgccgcaggttattacagctatttatgggctgaagtattatcggctgatgcttattcacgctttgaagaagaaggtattttcaacccaatcaccggcaaatcattcttagatgaaattctcacccgtggcggctcagaagaaccaatggaactcttcaaacgcttccgtggccgtgaaccgcaattagatgcgttgttaagacataaaggaattatgaactaatacgtcaaactatagggcatgcacaacatgccctttctcaaatattttcctcgacataaaaacatagtaaattttaaccgcactttatctagacaaaacctgcaaacgagacattatttttacaaatagctgtaagataaacgcatagaaattcacgcagaataaactaatttcctgtataatttttcacatatctatccaactcattacacaaaatattctgaggattttatggctgctgcaattcaacaacgtgccgaacttcaacgccgtatttggcaaattgctaatgatgtgcgaggctcggtcgatggctgggatttcaaacaatatgtgcttggcacacttttttaccgttttattagcgaaaattttgccaattacattgaagcgggcgatgaaagcgtaaattatgcccaattacctgatgaaatcattacacagatgccattaaaacgaaaggctactttatttacccaagccaattatttaagaatgttgcggctaatgctggcagcaatcctaatttgaatactgatttaaaacagatttttactgatattgaaaactcagcgacgggctttccgtctgaacaagatattaaagggttatttgccgattttgataccaccagcaatcgcttaggcaataccgtaaaagataaaaacgaccgcttaacggctgttttgaaaggcgtggctgaacttgattttggcaaatttgaagataaccacattgatttatttggcgatgcatacgaatatcttatttctaactatgccgccaatgcaggcaaatctggtggcgaattttttaccccacaaagtgtttccaaactcattgctcaaattgcaatgcacgggcaaacctcggtcaataaaatttatgaccctgcagcaggttctggctcacttttgcttcaagccaaaaaacaatttgatgaacatattattgaagaaggctttttcgggcaggaaattaaccataccacatacaaccttgcccgtatgaatatgtttttgcataacatcaactacgacaagtttgatattgctttaggcaacaccttaatggaaccacaatttggcgataataaacctttcgatgccattgtttcgaacccgccttactccgtgaaatgggctggctccgacgatccaacattgattaatgatgaacgatttgccccccgcaggcgtgcttgcaccaaaatccaaagcggactttgcctttattttacatgcgttaagttatctttcagcaaaaggccgcgcggcgattgtttccttccctggtattttttatcgtggcggtgccgagcaaaaaattcgtcaatatttggtggataataactatgtggacgcggtgattgcgcttgcgccaaatctcttttttggcaccagtattgcggtgaatattttggtgctttccaaacacaaacccaatttatcgatgccagcggtttatttaaatctgccactaataaccacattttagaagaggaacatatcgagcaaatcctcaaactgtttgccgataaagaggatgtgccgcatttggcaaaatccatatcctttgaagaaatcgcccaaaatgactacaaccttgcagtaagttcgtatgtggaacaaaaagacactcgtgaagtgattaatattgatgaactcaatgctcaaattcgtgaaactgttaccaatattgaccacttgcgtgcggaaattgacaagattgttgcagaaattgaagggtaaaatgtagggtgggcttcagcccanatttacgataacaggtagtgggctaaagcccaccctacgaggaacaataaaaaaacaccatgaaaaacaaccgcacttttttagaaaaattattggaggggtctgaggttgagtggaagcctttagatgaagttgccaatatcgtcaataatgcaagaaaaccagtcaaatcatccttacgagtgtcagggaatattccatattatggtgctaataatatccaagattatgtcgaaggatatactcacgagggcgaatttgtattaattgctgaagatggttctgctagtctagaaaattactctattcaatgggctgtaggtaaattttgggcaaataaccacgtccatgtagtaaatggcaaagaaaaattaaataatcgttttttataccattatttaactaatatgaatttcattccattcttagctggaaaggaacgtgcaaaattaacaaaagctaaactgcaacaaattccaatccccatccccccactctccgtccaaaccgaaatcgtaaaaattttggacgcattgacagcacttaccagcgagcttaccagcgagcttaccagcgagcttaccagcgagcttatactacgccagaaacagtatgaatactatcgagaaaaattgttaaatattgatgaaatgaacaaggttattgaacttggtgatgtagggcctgttcgtatgtgtaaacgaattcttaaaaaccaaacagcaagctctggagatattccattttataagattggaacttttgggaaaaagcctgatgcctatatttcaaatgagcttttccaagaatataaacaaaaatatagctatcctaaaaaaggagatattcttatatctgctagcggaactattggtagaacagttatatttgatggagaaaattcttattttcaagatagcaatatcgtctggattgataatgatgaaactctcgttcttaataaatatttatatcatttctataagattgctaaatggggaattgcagaaggaggcaccattcaacgtttatataacgacaatttgaaaaaagtaaaaatttctattcctccattaaaggaacaacaccgcatcgtttcaatcctagataaatttgaaaccttaaccaattccatcactgaaggcttacctttagcgattgaacaaagccaaaagcggtatgaatattaccgagaattgctattaaatttctcgtaacccgtagtgggcttcagcccaccaattaaccataacaaacggtgggttaaagctcaccctacaatgtaatgagaatatttttatggtgggctaaagcccaccctacgaactacaatttggaataatatatgtctaattatcggcgcgattttactaaaggtggattatattttttcacaattgttttacaagatagaacaaaatcttatctaactgactatatcaatgaatttagatctgcatataaacaaacttgtgaacattatccattcgaaacagtagcaatttgtattttgcccgatcatattcatttactgatgcaattacctgaaaatgatgataattacgcaatacgcatcgcatatttaaaaacacaatttacacgacaacttccaaaagaatgccgacaatttaataaaaatagacaaaaatatcgagaatcaggtatttggcaacgccgattttgggagcatttaattcgtgatgataaagatttagcgaatcatttagattatatttattacaatcctgtgaaacacggctatgttgaggtagtaaaagattggccgtattcttccttccatcgtgatgtgaaagcagagatttatcctgaagattggggaggcaacccagatttgaaaattaaaggtgatatataacaatactgtagggtgggcttcagcccacaattaaccataacaaacggtgggctaaagcccaccctacaatgtaatgagaatatttttatgatgggctaaagcccaccctacgaactgaataactgaaaaatatactaaggaaaaaccatgacccaatacaaaactatcgctgaatccaataattttatcgttttagatcaatataataaatttgtggaagaatctaatgctggttatcaaacggaaaggagccttgagcgtgagtttattcgtgatttacaggctcaaggctatgagtatttacaatggcttaataatcacgatgaactgattaaaaacttacgggcgcaattacaacgcttaaataacgtggttttctccgatgcagaatggcaacgttttttagaggaatatttggataaaccgagcgataatctgattgagaaaacccgcaaaattcacgatgattatatttatgattttgtgttcgataacggacgcattcagaacatctatttgcttgataagaaaaatcttgccaataattctctgcaagtcatcaatcaatttaagcaaactggcagctatgataatcgttatgatgtgacaattttggtgaatggtttacccctttattgaattaaaaaaacgcggcgtggcgattcgtgaagcctttaaccaaattcaccgttacagcaaagaaagtttcaataaagaaaattctctctttaaatatattcagatttttgtcatttctaatggcacggatactcgctattttgctaatacgactaaacgcaataagaatagctacgacttcacaatgaattgggcaacggcaaaaaatactctgattaaagatttaaaggattttaccgcgactttcttgcaaaagaatactttgctcaatgtgttggtaaattactgcgtgtttgatgtgagtgatacgttgttaattatgcgtccgtatcaaattgccgcaacagaacgtattttatggaaaattcaaatttcttacttagcaaaaaattggagtaatcgtgaaagtggtggctatatttggcataccacaggttcaggcaaaaccctcaccagttttaaagcctctcgccttgcgactgaacttgattttattgataaagtcttttttgtggtcgatcgtaaagacttagactaccaaacgatgaaagaatatcagcgtttttcgcctgatagcgtgaatgggtcggaaagtaccgctgggcttaaacgcaatattgaaaaagatgataacaaaattatcgtaaccaccattcaaaaattgaataatttaatgaaaagtgaagaaaacctgtctatttatcaaaaacaggtggtctttattttcgatgaagcacatcgctctcaatttggcgaagcacaaaaaaatctaaaacgtaaattcaaaaaattctatcaatttggttttactggcacgcctattttccctgaaaacgcattaggtgcggaaacgacagcaagtgtgttcggtgcggaattgcattcttatgtgattaccgatgctattcgtgatgacaaagtactgaaattcaaagtcgattacaacgatgtccgcccacaatttaaagccttagaaacagaaaaagatcctgaaaaattgaccgcacttgagcagaaacaagcctttttacaccctgagcgtattaaagaaatctcgcaatatttgcttaacaattttaaacagaaaacccaccgcttgaatgccacaggtaaaggctttaatgcaatgtttgcggtaagcagtgtagaagcagcaaaacgttattacgaaaccttacaaaatttacaggcagagcaggaatatccgttaaaaattgcaacaatcttttcgtttgccgccaatgaagaacaagatgcgattggcgatattccagatgagacctttgaacccactgctctaaacagtacggcaaaagaatttttaacaaaagccattgatgattacaatcactactttggcacgaattatggcgtagatagtcaatcattccaaaattactatcgcgatcttgccaaacgtgtgaaaaatcaggaagtggatttactgattgtggtcggaatgttcttaacaggctttgatgcccctacgttgaatactcttttcgtggacaaaaacttgcgttatcacggattaatgcaggctttttctcgcaccaaccgcatttatgacacaactaaaacctttgggaatatcgtcactttccgcgatttggaacaaaataccattgatgcaatcacgctatttggcgataaaaatacgaagaatgtcgtactagaaaaaagctacgacagctattttaacggtgatgacaatcaacgtggctatgcagaaatcgtgaaagaattaaaagaaagctttcctgatccaacagaaatcgaaacagagcaagataaaaaagagtttgtaaaattatttggcgaatatttgcgtgtcgaaaatattttgcaaaattacgatgagtttgcagcattgcaagccttacaagcggtcgatttaaatgatccgattgcaatggaaaaattcaagcaagtacattatgtgaatgatgaacaaattgcagaaatgctgaaagtacccactttaccagtaagagcggagcaagattatcgttcaacttataatgatattcgcgattggttacgccaaagaaaagaggggaatgataaggataattcgccgataaattgggatgatgtcgtgtttgaagtggatttattaaaatctcaagaaatcaatttggattatattcttgcgttaattttcgaacatcataagaaaaaccaagacaaagaggtgttaattgatgaaatccgccgcacagttcgttcaagtttgggtaaccgtgcgaaagagagcttgattgtcgattttatcaaccaaacaaatttagatgatattcccgataaagcgactttaattgactcattcttcctatttgctcaagcagaacagcgaaaagaagcagaatccttaattcaagaagaaaatttgaatgtcgatgcagcaaaacgctatatcagcacttcattaaaacgggaatatgccagtgaaaacggcacggcacttaatgaagtattgccaaaaatgagtctacttaagccacaatatctcactaaaaagcagaagattttccaaaaaattgctgcatttgtagagaaatttaaaggggttggaggaaagatttaaatttaatatatcaacaattagacatcttattaagacataaaggcattatgaattatgaattaataatacaaaacatactggtcaatatttaactagtcgtgataataaaaacagctccaatttatacttggagctgttttttatatcgataaacttactttttacgtgctaaaattcgatttgcacactctgctgcagctgttaagccacctgccatcataataatatctttaatcactaaacgaccaactccagataaataagggaaaccataggctggcgttggtaaatctccacctagattaggcacccaagcctcgggcgttgtgattaaaaatgacagcgtgactattgacatgccaaatgtcagtaggcctcctgccaaacctgccgttgcattccaaataccagctaaagtaagaataccaacagtaacaataattgctccaataatgtaagaagccgtataggtgccattttctttatgccattcgatgttttttgcaaccatttttccttcaggatttttgtgtagtgtatattccatcactaactctcctttatcattcggcactaaatttggccctttttcatacatatagctaaaaaacgggctatttgatacaaagtgagcaattccatctgcctcatattgacaaactttcaaaccaccgatccatgccattacaataaaaatagcaatacggataaaattaataaattgacgctgcattggtgcaacaattctcgcgacaaattcaacaaatgtattaaatactgacatataaatttccacataaaagtaaataaaattgagagcctaattctactcgctttaatattaaaaagcaaaatcaattccctttaataaaagataaataacggagaaatttgaaaagttttactaattaaaataaaatttgattttcccattttaagcctctttattatctttaaatcacatgtaaataatctttacacaactaccttataatattaaaatttacaaaatttaagcaaatcctccacatcttctaaccaaagatttccaattttatcaatcaattctccacaattaaaaacatcagaatttttagccgcactttctaaagtatccgctaattgacgtaaatgatttaaccctaccgatgccgctgcgcctttaattttatgggcggtatcttctgtttctttcatattatcttttgataattgagccagataatttggcatagtttgtttgaataaagataaattttctaaaatttgggattttccaagtgtttctatcagcgctaaatcaaactgttctgaaagctcattatcatcattcatttctataatagattcgctttcatccgcaaaaaattgctgtagacaatggtgtaaatccttaattgaaatgggtttacgtaatacgccatccatgcccatttctaaatattcttgctcgctttgcataacattggcggtaaaagcaatcattggcggtaaaaaatcataaataccgttttcatagttctctcgcaaatattgggcaatttcaaaaccactcatatctggtaatttaatatcgagcaatagaatgtcataaacatttttctcaaataaagtaatcgcctgcttgccatttgtcgcaacatcaacatgatgcccaagtttttctaaaatagtttttgcaaccataatattgagatcaacatcttccactaaaagagtattcaaggatggtatattttncttaacagattctttttcagaaatttcctgagcgtggagagtnagatggaaagtcgcgccttttcctcgttcactttcaactgttaaatccccttcccattaactgagcaagatttttagaaatagccaacccaataccgctacccgcactttgctggcggctttctttcacttgataatacatttcaaaaatatgtttttgttcttcaggtgaaatccccattcctgtatctttcacaataaaatggtaacaatcctgatttctcataattttaagaataatatttccctgatccgtaaacttcaccgcattactaattaagttccacaaaatttggctcaagcgaacacgatcaagattcaaccaattaggcaaattaggttcaagctctaaagaaaaaataagatttttttctttggcgaggaaactagcaaaattataaatatcgtttaataaggcagggaaatctgttggctggcgatttaattcaattcggctggcatcaattttttccaaatcaataatatcgctaaaaatatagcctaaactgaccgcacttatgttgatagtttttaaataattacgctggagatcatccaattcatcatcaagtaaaatctggctaagcccgacaatcccattcaatggcgtgcgaaattcatggcttattgtggcaagtaaggtacttttatcacggctatttttttctaacttttccaatgcttgggataattttttctgagcagcaattcgctcggcgacctcattttccaatcgattaaccgagctagaaagatcaagacgagaatgttcaagtttttctactaataaagtgaaaaaataaataacaaaaggcgcagtgagtaagccaaaagttaccgaacgaaaaatatctacccaagatatctgatgaacaataaatagactaaataaaatctgagtacaaagagctaaaaccgcgagaatcatcacgcctaaaagagaaaaacgaagacgcccaagacgaataacccaatccacataactctgagcaaaatatttgaaatttttcatcaaatctcctaaaacattattatcgttataaaaaaaacctgtgcatataggctttattatatccataaagtaaacgagattgttattactatgtatgcgtaagaaatgaaaaacttaatctttattaattatctgtttgactaaaatttgtaattcaggaataacttgctcttcaaaccaaggattctttgttacccaaagctgattacgtggggaagggtgcacgagaggcataaagtgcggtaagaattgacgataatttttaacagtgttagttacattatctttattttcgggtaaataatatttctgtgcatattgcccaataagaatagtgagctgaatattaggtagattccctaaaatcattggatgccatctttctgcaaaaccttgacgaggtggtaaatcacccgatttaccttttccaggataatagaaatccattggaagaaccgcaaatatcccagaattataaaaataatcgtaatctactcccaaccattctcgcagacgatcaccgcttttatcattccaatacaaacgagattgctcagcttttaacccaggagcttgaccaacaatattaattcgagctgttttaggagccgaaaataaagggaaaattccacgttctgtaaaatctttattttgaggatcagcgataatacttgaagttatttcgtctaaatttttaagcataatgaaggagattagaaatgaatatataaagtctatttgaaaaatatgaaaaatcaaaactctaaatgatgtaaataggtatatttattaaaactatattgtaggcaatacaaaactaaaaacttgatattgaaatacaatctctattttctactttaatccttttcatgaaataatgaataaattcccaaaagctaaaaccccatatctttcgacacggggcccttctgtttttatttaacttagataagtatttggtaacctggcggtgccctactctcacatggggaaaccccacactaccatcggcattacagcgtttcacttctgagttcggtatggtctcaggtgggtccaccgcactatcgccgccaggataattctttgataactcgtcttttctcttttatctctcgtctcttttatctctcgttactcagtctttcctctacctttcactcgttcttattggtcacaagctgaatccgattttctttctattaagtcttctatatttacttttctttgtttagtcttttacttctctttcgctctgcttttatttgcttcgcttttcatctcttacttcacttagctcccaaaaacacttgagcgttgtatagttaagcctctcgggcaattagtattggttagctcaatgactcacatcacttacacacccaacctatctacgtcgtagtctacaacaacccttactgacttaaagtcagggatgactcatctcttggcaagtttcgtgcttagatgctttcagcacttatctcttccgcatttagctacccggcaatgcgtctggcgacacaaccggaacaccagtgatgcgtccactccggtcctctcgtactaggagcagccccaatcaatcatcctacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctctttcgatgacaccatcaattaaccttccagcaccgggcaggcatcacaccctatacgtccactttcgtgtttgcagagtgctgtgtttttaataaacagttgcagccagctggtatcttcgaccggttcaaccttcaggggctagcccttacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagcccacctctcgatgaaccttcttccgcttacacaacgctcccctacccaacagaataaattctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaagccgggatggccccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactattcgcccagttaagactcggtttcccttcggctcccctattcggttaacctcgctacaaaatataagtcgctgacccattatacaaaaggtacgcagtcacaaggttgccctcgctcccactgcttgtacgtacaaggtttcaggttctatttcactcccctcaccggggttcttttcgcctttccttcacagtactggttcactatcggtcaatcaggagtatttagccttggaggatgggccccccttcttcaaacaggatatcacgtgtcccgccctacttctcgttagcttagtaccacaatatggtttttagatacgggattatcaccctctttgattgtgcttcccaacacattctcctcactatattgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtattttcattcaactaaacacttgattgcttttgttcaatcaagatttttttacaaaacaggttttgtttttagagtttccttttcagttctctctttcactttactgttttgcctactcagactttctctcgaaaatctcttgttttcagcttgtttccaattttttaaagaacagtaagacaatctaataaagttatctttaattggcgtccccacggggattcgaaccccggttaccgccgtgaaagggcgatgtcctaggcctctagacgatggggacatcaattaaagatactctattttctttttatcttttaacgtttatttttcaacgttgctttcgcttcgtttttaatcttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcctaggttaagcccagggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtactattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactgcttagctataaataaaacactacttaaaaaagtaatgatgaattttcagttaagcacctattaagacttcaaaattaaaaatagttttaaaacaagtcaatcaacaagtgcccacacagattgtctgatatattgttaaagagcaaaaaataacgacgcacttggaaacttaaaaaacttcacaacagtgcgtcgttgtgtgcggtgcattatagagattttcaaatcccttgcaagtacttttttgtaaaaatatttaaaaaaatgatcttttgatggaaatataaacattttattaaaaagtgcggttagaatagtcaaacttttattgctattatttcttacgtaatgaaacttctccaccattaaacatctgaattttattgccacataatacttttaaataaccacgttcatctatgccttgttcaatacctgaaataacgccttgctcagtaagcacatttatttcactatttgaaaacgcattatatgattgccatgcttgttgaaattcctcatcaataccattttgttcaaagatatttaaacgtgtatataaatgttgtataagtttgggtaataaagtttgtcgctctacatcaggatcaatttcacacacttccgcataaggctgactaatttctgtttgttttgacaacgacacattaatacctatgccaatcactaaattgagcatgccatttttatgattagcaatttcaactaaaatgccacctaactttctttcatcaaacaaaatatcatttggccatttcacttgtacatttagcacttccgcaatcgccaaaccgatgactaaacttaacccctcaattgattttttaggatcaaatgcccaataaaaactaaacatgatttgcccggcaaaaggcgataaccattggcgaccacgccgacctcgtcctgcagtttgatattcagccacacaaagatcgcctttttttaatgaaagaatattttgtagtatccattcatttgtagaggaaataatcggctgataatggatactataaggaaaaagtgcggttgaaatttgctgaggatttaataaaggaagcattggcactaagcgataatcttgtccatcaacgagaatatccaaaccaatttcacgtaattgttgaatatcttcctctagatttttagaaaatttttccaattcagaccgcactttcggctgacaatccgctaaatatgtcaataacgtaaaattcatcattcattccttatggcaaatagtatgaaaatcatagcataaatcctaaaattnngttttcaaaataaagtgaaatctgtataatctcgtcgcaatattttttaacttcaacttattagcgagaatattgcaatgtcattacgcattaaacaagangcccttacttttgacgatgttctactcgtcccagctcactcaactgtgcttccaaatactgccaacctttcaactcaacttactaaagaaattcgtttaaatatcccaatgctttcagcagcaatggataccgtaactgaaaccaaacttgcgatctctttagcacaagaaggcggtattggctttattcataaaaatatgacgatcgaacgccaagcagatcgcgtgcgtaaagtaaaaaaattcgaaagtggtatcgtttctgaaccagtaactgttttaccaaatttaacgcttgccgaacttgctgaaatggtgaagaaaaacggatttgcgggctaccctgttgtagatggggaaaataatttaatcggtatcattactggccgtgatacacgtttcgtaaaagatttaagcaaaacagtttcacaagtaatgacgaaaaaagaagacttggtgaccgtaaaagaaggggcgagtcgcgaagaaattttggaattaatgcatcaacaccgtgttgaaaaagtattagtggttaatgatagtttcaaacttaaaggtatgattaccgttaaagacttccaaaaagcagaacaaaaaccaaatgcatgtaaagatgaattcggtcgtttacgtgtcggtgcggctgtaggtgcaggtgctggcaacgaagaacgtattgatgccttagtgaaagcaggcgtagatgtactattaattgattcttctcacggtcactcagaaggcgtattacaacgcgttcgtgaaactcgtgcaaaatatccaaatttgcctatcgttgcaggtaacgtagcaacggctgaaggcgcaattgcattagcagacgcaggtgcaagtgctgtaaaagtaggtattggtcctggttcaatttgtacaactcgtattgtaactggcgtaggtgttccacaaattaccgctatcgcagatgcagctgctgcattaaaagatcgtggtattcctgtaattgctgacggtggtatccgtttctctggcgatattgcaaaagctatcgctgctggtgcaagctgtgtaatggttggctcgatgtttgcgggtacagaagaggctccaggtgaaatcgaactttatcaaggtcgtgcatttaaatcttaccgtggtatgggctcattaggtgccatggcgaaaggctcatcagaccgttatttccaatcggataacgcggcagataaactcgtaccggaaggtattgaaggccgtattccatataaaggttacttaaaagaaatcatccaccaacaaatgggtggcttacgttcttgtatgggcttaacgggctgtgcaactattgatgaactacgcaccaaagcggaatttgttcgcattagcggtgcaggcattaaagaaagccacgttcacgatgttgctattactaaagaagcacctaactatcgtatgggctaatctttaaggtgggctttagcctgccttttgctgtttaaagtgcggttggtttttgcaaagttttaaataatatgaaccgcttacactatcaataataagagcattataaatgacaaatatccactatcacaaaatcctaatcctcgactttggttcacaatacactcaactgattgcgcgtcgtgtgcgtgaaatcggtgtgtactgcgaactttgggcttgggatgtaaccgaacaanaaatccgtgaatttgctcccgaactttatcaaggtcgtgcatttaaatcttaccgtggtatgggctcattaggtgccatggcgaaaggctcatcagaccgttatttccaatcggataacgcggcagataaactcgtaccggaaggtattgaaggccgtattccatataaaggttacttaaaagaaatcatccaccaacaaatgggtggcttacgttcttgtatgggcttaacgggctgtgcaactattgatgaactacgcaccaaagcggaatttgttcgcattagcggtgcaggcattaaagaaagccacgttcacgatgttgctattactaaagaagcacctaactatcgtatgggctaatctttaaggtgggctttagcctgccttttgctgtttaaagtgcggttggtttttgcaaagttttaaataatatgaaccgcttacactatcaataataagagcattataaatgacaaatatccactatcacaaaatcctaatcctcgactttggttcacaatacactcaactgattgcgcgtcgtgtgcgtgaaatcggtgtgtactgcgaactttgggcttgggatgtaaccgaacaacaaatccgtgaatttgctccaacgggtatcattctttctggcagtcctgaaagcacaactgaagaaaatagccctcgtgcaccggaatatgtatttaatgctggtgtaccagtattaggcatttgctatggaatgcaaacgatggcgatgcaacttggcggcttaaccgaaacgtctgatcacagagagttcggctatgcttccgtttctcttgaaaattccaccgcactttttgcaaatcttaacgataatttaaccgcttctgagccaaaattagacgtttggatgagccacggcgataaggtaacgcgcttaccagaaaacttcaaagtaactggcacaacgctaacctgcccaattgctgcgatgtctgatgaaagccgtcgtttctacggtgtgcagttccaccctgaagtaacgcatactaaaaaaggcttggaattattaaccaacttcgtagtaaacatctgtggttgcgaaaccaaatggacagcagaaaacattatcgaagatgccgttgctcgcattaaagagcaagtgggcgatgatgaagtgattttaggcttatctggtggtgtggactcttctgtggttgcattacttttacaccgtgctatcggcaaaaacttacactgcgtatttgtggataacggtttactccgcttacacgaaggcgaccaagtcatggaaatgtttggcgataaattcggtttaaacatcactcgtgttgatgctgaaagtcgtttcttaggtgaacttgcaggcgtatctgatcctgaagcgaaacgtaaaattatcggtaaagtgttcgtggatgtattcgatgatgaatcgaaaaaactcactaatgtgaaatggttggcacaaggtacgatttaccctgacgtaatcgaatctgcagcaagcaaaactggtaaagcacatgtgattaaatcacaccacaacgtaggtggcttaccagactatatgaaacttggtttagttgaacctttacgtgaattatttaaagatgaagtacgtaaaatcggtttagcattaggcttaccagctgaaatgatcaaccgccacccattccctggcccaggcttaggtgtgcgtgtattaggcgaagtgaaaaaagaatactgcgatttattacgccgtgcggatgcgatctttatcgaagaattacgcaacagcggttggtatgaaaaaaccagccaagccttcagcgtattcttaccagtgaaatctgtaggtgtgatgggcgatggccgtaaatacgattgggttatttccctacgcgcggtagaaacaatcgattttatgaccgcacattgggcacatttgccttatgatttattaggcaaagtgtctaaccgtatcatcaacgaagtgaatggaatttcccgcgtcgtatacgacatcagcggaaaaccacccgcaacaatcgagtgggaataaaaaatcactttttcagatactttctaattatttcagtaactttaataagtgcggttaattttcaccgcactttctttttgtttaaaagcccttctatgccaatcacaatgagacttaaccaaataggcacataagtaaaatagtcacttgtggttatttgattatctagcacaaagacagctattaaaaaaagcaatatgggttcaatataactcaacaccgcaaaaatactaactggaatttgttggcttgattttaagttggctgaaagcgaaatcgcactcacaataccaagtgctggtagcaataaccaataacgatattcttgcgtaaccaaagaaagcgtatcgctttgagaaagaatataaataaaacaaggaatcgaaattaaaataatatccaatgtaattccttgtagagcagggattttcatccatttacggcttagataataaaatggataaaccgtacaaacccacaagcttgtccatgaaaaactttgagtgtgccataattcatgtgcaacaccgcagcagccagtaaaagcgcgattttctgaataaatgataaacgttcttttaaccaagcccatcctaaaacagccataatcagcggaaaaagaaaatatcccatcgcaatatttatcccttcgccatttagcggtgcccacataaagagccagaattgacttcccgcatctagtgtccccagtaaaaataaaacccaacgcgtccaactttttcctaaagttgtcgtaataagagacaaaagagagcggcaaccaatagtcggaaatagaattaaaagtaacccaaagatcatggtcagcatacgccacgcaaaaacatccgttccgctaagtggttggagccatatactaaataaatacaatatgccaaataaacattgtgaaaaaatgcacaataatatgccttgagtgactactttcatcttgaacttcattcatctcatcaatgtgattattataaaagcccaaggcaataaaaaatctcaactttattttttattgtgataatatttttctcaatagttacatttttgagaaattatcttatgcaaacactggataaattagatcgtcatattttgaatgtattacaacaagatgccatgattccgttaaaagaactgtcagagaaagtgaatagttccgttgcaacctgtcaacgacgtgtgcaatcattaactgattcaggcattattacaaaacgagttgcagttgtttccccaaaagccgttgggcgtacgattagcgtatttgtcatggtcgaaatggataatcaacattcttattatcaagagcaatttgaacggaaaatgcgtcaagaagacgaagtggtgagctgttacgaaatctcaggggactatgattttatgttgctactccatgcaaaagatatggaaagctatcacgcattcacacgccgagtattgacgggtgaatttcatgtaagaacttataaaagtttatttgtaatgaattttaccaaagcagatagtggaattatcttatagaacaagtgcggtaaatttttaccgcactttgtgtatgattagtttagttttgtcgtttgttttaagaataaatacccaagtattgccgaaaccgttgatccaagtagaatacctaaacgagaaagagtattgacactttcccccgcattagcatcaaacgcaaggcttgctaagaacattgacatcgtaaaaccgattccacataaaaccgcaacagcaaaaatttgtttaaaattaattccatccggtnatttagctaatcccaatttaacagaaatataactaaatccaaatataccgactggtttaccaataattaaaccgcttgctatagccaataataatggcgacgaaatcatattcacatctatgcctgcaaaactcacaccagcattggcaaatgcgraaagtggtaaaataacgaaagatgaccaagaggctraaatatgctcgaaatcatctaatgggcgttctccttttttacctttcaatggaatgctaaaaccaataataacgcctgctaaagtagcatgcacaccagactttaatacggaagcccataaaattgcacctacgaccatataagcgcaaagtgcagaaactctgaaacgatttagtaatatcagcacaataattgccacggcagaaaaaattagtgcttgcacactcaatccgtgcgagaaaaataatgcaataacaactatcgcaccgaggtcatcaataatagcaagggcaagtaaaaatattttcagtggaagtggcacttgtttactcaataacgccataattcccagtgcaaaagcaatgtctgttgccattggaattgcccagccattagctaaacttggatcttgtttagcgataaaccaataaactacagccggtataaccattccgccaatagctgcaatagcagggaaaatagcttgttgataggtagaaagcgcgccttcaaataattcttttttgacttccattcccactaatacaaaaaacaccgccataaaaccatcgttaatccagtgaattaaggttttattaattgagaaactaccaatttgtaaacttacaggcaaatttaaaaaatcattatattggttgcttaacggcgaattagccagcaacatcgcaacaacagctgaaaaaagcaataatataccgccagcagattctaatttaaaaaaacgttggatcagttttatcacataaacccctttaaaaatacatagcaaaaaattcacaaaggaagcatcctagcatattttcgaagttaaaggaaaaagtgcggtagattttgtcgggatttttagcgaattgtcgataaaatgccatatattgtgacaaaattcacatttttaattttacacaatagagattttatctactttgtagtagaatgcggaccttttatttttagaatcaaaaactatgttttcacgcaaagatattatcgttttaggaatgatgatcttcgccttatttttaggtgcgggtaatatcatttttccgcctatggaaggattttcctcaggacaacattggacgagtgcttccttaggctttgttttaactggcgttttaatgccatttattacgcttgtggtggtagcgattttaggtcgtggcgaagaacttactaaagatttaccaaaatgggctggcacaggtttcctcgttatactttatttaaccattggctctacctttgcaatgccccgcatcactaatgttgcttatgaaatggcgtggttgcctttaggcttaacagaaaataatgcgaatgttcgttttgtattctcactcatttttaacttaatcgcgatgggctttatgattagcccaaatacgatcatttcaagcgtgggtaaatttatgacaccagctttattagtgttacttattgctgtagcaattaccgtatttatttcgcctttatctgaaattcaagcgccaagtaatgcttatgaaaatagccattctttattaatcggtttaactagcggctatcaaacgatggatgtacttgcagccatcgctttcggtggaattgtcgcccgagcattatcagcgaaaaatgtgacaaaaaccaaagatattgtgaaatacaccatttcagcaggatttgtttcagtcatcttacttgcgggtttatatttttcgcttttctatctaggcgcaactagtgctgcagttgcagaaggggcaacgaatggtggacaaattttctctcgttatgtaaatgtcttattcggttcagctgggacttggattatggcaggtattattgtgttagcgagcttaacaacacttgttggtgtaactagcgcatctgctgattatttttcaaaattctctgtgcgtttttcttatccattctgggccgcactttttaccgcaatgacaatcactgtttcacaatatggtttaacggatctacttcgcataacgatcccagccttgttattaatttacccagtagccattgtgcttgttttattgcaattcttacgaaaaaaacttccatcaataaaatttacatacaatagtacattgctcgttacagtttgttttagtttatgtgacagcttaaataacgttaaaatgttaccagaaagcatcaattcattattgaaacacttccctctttcatctgaaggaatggcttggttggttccgactttagtaatgttagttgcaagcatttttattggaaaagcattgcataaaacccattcttaatctcacaaagtgttttatttatcagccctgtgccgtaaaactccgtccttcagggcggagatataaggcacagggctgataaatttctaaccgcactctttcaaaaatcaaattaatttaacaggtacttttacgactaattttttaattttttctgtttttccattcactacacagcaaggcttgtgcggttcataaggatagaatacagcgaacatttttggtttcattgtgacggtgaatttatcatcaatatctgcacaaagttgataatcatccgcttcgttgtaatcttcatacttagataaattcggataggttgcacccacttcgatattttccgtgccacgaataagcacttgtacatctaagtattcatgatgtaattctgcttttttactgcttggttctgcagtttctggttccattacgttcatataaatttgatcgttaatatcatggcgaccattctctaacgcattcaaatctaacgtatttaaataatcacatacttcagcaatcacttttggtaaaccaactttaaaatttgggttggttaaactgctaataatcatagaattttccttatagtggataaaagttacactatgataccaagtcagttaaatgaaataaagccaccgattacatcatctctcttgattaatccaattagctcttgtagtaccgagtggaagagagcaaatatcttgccaacttattgacgcataaagtctaaacaatgaaattacggcattaacacaagcattttcagaaaaaatattatcaagaggcttatgaggacctgtaaaatgaaaaatattaggagaagtatcaagagtattaattgaaatcatatgaactaattgtaatgttgaatagcgtttagcaaaataaagttgaagatcattttgccacgattcagaaatatctcctgtatgtaaaataaaaacagagagattttcattgtgcattaataaagatttcagtgtaatttctacattaaggaagataattagcatcactagccatcattacattatatttcatataaaagaacctaatttcagagagracaatcaatttttaggaggaaaatactgtcgaaacaatgataattaagttggtaatgtgaaataaagttagccattaaagccaaacatcctgtataatgcacgggctttattttctacattagcgtgcggctatcaaaagaaatttttaaacgcccaaagtgcggtcattttttcgaaagatttcttttgctagtcgcaatctgggaaataaggcattgtttttaatataaattttaaggaaaacattgtgaatccaattgttaaacaatttaaatacggtcagcataccgttactctagaaactggtgcgattgcacgtcaagcaacggctgcggttatggcaagcatggacgataccacggtattcgtgactgttgttgctaaaaaagatgtgaaagaaggtcaagacttcttcccattaaccgtaaactaccaagagcgtacttatgcggcgggtaaaatcccgggtggtttcttcaaacgtgaaggtcgtccatctgaaggcgaaactttaattgcacgtttaattgaccgtccaattcgtccattattcccagaaggtttcttcaatgaaatccaagttgtggcaactgtggtttctgtaaacccacaaatcagcccagacttagtggcaatgatcggtgcttctgcagcattaaccttatctggtgtgcctttcaacggccctatcggtgcagcgcgtgttggttttatcgacaaccaattcgtattaaacccaactatggcagaacaaaaacaaagccgtttggacttagtggttgcaggcactgacaaagccgtattaatggttgaatctgaagctgatattttaactgaagaacaaatgttagcagcggtcgtattcggtcatcaacaacaacaagttgtagttgaagcaatcaaagaatttgcaaaagaagcgggcaaaccacgttgggattgggttgcaccacaaccaaacacagatttaatcaacaaagtaaaagcgattgctgaagcacgtttaggcgatgcataccgcattactgaaaaacaattacgttacgaacagatcgatgcgattaaagcggatgtaaytgcgcaaatcacagctgaagatgaagaaaycagcgaaggtaaaatcgtggatattttcaccgcacttgaaagccaaatcgttcgtggtcgtatcattgcaggcgaaccacgtattgacggtcgtaccgttgatactgttcgtgcattagatatttgcactggtgtattaccacgtactcacggttctgcgatttttactcgtggcgaaacgcaagcattagctgttgcaaccttaggtaccgaacgtgatgcacaaatcattgatgaattaacgggtgaacgtcaagatcacttcttattccattataatttccctccatattctgtaggcgaaacaggtatgatcggctcgccaaaacgtcgtgagatcggtcacggtcgtttagcaaaacgtggtgtagcggctgttatgccaagccttgcagaattcccgtatgttgtgcgtgtagtatctgaaatcactgaatctaacggttcttcttctatggcgtctgtatgtggtgcgtctttagcattaatggatgcgggcgttccaatcaaagctgctgttgcaggtatcgcaatgggcttagtgaaagaagaagaaaaatttgtggtgctttcagatattttaggcgatgaagaccatttaggcgatatggactttaaagtggctggtacacgtgaaggtgtaaccgcccttcaaatggacatcaaaattgaaggtatcacccctgaaattatgcaaattgcattaaaccaagcgaaaagtgcacgtatgcacattcttggtgtaatggaacaagcaattcctgctccacgtgctgatatttctgactacgcaccgcgcatctatacaatgaaaatcgatcctaagaaaatcaaagatgtgattggtaaaggtggtgcaacaatccgttcactaactgaagaaactggtacatcaattgacattgatgacgatggtacagtgaaaattgccgcagtagacagcaatgcagcgaaaaacgtaatgggacgtattgaagaaatcgttgcagaagttgaagctggcgtaatttacaaaggtaaagtcactcgtcttgctgattttggtgcattcgtcgcaatcgttggaaataaagaaggtttagttcatatttctcaaattgctgaagagcgtgtagaaaaagttagcgattaccttcaagtgggtcaagaagtaaacgtaaaagttgttgaaatcgatcgtcaaggtcgtattcgtttaacaatgaaagacttggctccaaaacaagaaactgaaattaaccaagaagattctgtcgaagaacaggaataatcttggaatatagaatcaaaacttggtagcattcgctgccaagttttgttgttttccaacttttaggcataaagaaagcaaatgcggtgttttcgcttatctcgccattttatagtctatttatttagcttatgtgcgatcttactccttgctggctgtgttcagtctaggggcggttttgtgtctaaaaatcatgtcgtgttggctgaacaaaacccgaatactcactttgaacaagaagtgatgatcgtgcgattaagccaagtactactggttggaaaaatgagtaatgaagaacgcgcatcgctacattttgaacgtggcgtactctatgattctcttggattatggggacttgctcgttatgatcttactcaagcccttgcattacagccgaaaatggcatctgtgtacaattacttagggctttatttattgcttgaagaagattacgacggcgcattggatgctttcaatacggtgtttgaattagattcaggttatgactatacccaccttaatcgtggtttaaatttttattatgtagggcgctaccatcttgctcagcaagatttcttacagttctaccaagccgataaaaaagatccctatcgtgtcttatggctatatttgaacgaacaaaaattaaaaccacaagaagcccaaacaaaccttgttgaacgagcaaaagggctatcagaggacttctggggtacacatatcgttcaatattacttaggacacatctctgtagaagaattgcaacaacgtgcaagtgaatttgccgaaaattcacaacaatatgctgaaattctcacagaaacctatttttatctagcaaaacaaaaactcaatgtagggctagtagatgaagcagcagctttatttaaactagctatggcaaatcaggtttataactttgttgagtatcgttttgccgcgtttgaactcatgaaattaaaaccggttcaaacagaagacgaaaaagaagagaaaagtgcggtaacaaaagcgattgttttctaaaaatcaatccaaaacttaccgctctttgcagtagaacgaatagaaaaattcattcgctctgctcaacttaataaaccgaaggcctctttgagctttccttatttatattcgagtattttaatgactgacaaaattactttcaatgacttaggcttacctgagttcatcttaaaagctgtttctgacttaggttttgaaacaccttctccaattcaacaatcttgtatcccgcatttgctcaatggcaatgatgtgctaggtatggcacaaacaggtagtggtaaaaccgctgcctttgcactgcctttactcgcgcaaattgatccaagtgaaaaacatccacaaatgttagtaatggcacctacacgcgaacttgctattcaagttgccgatgcgtgcgaactatttgttaaatatgcacagggcactcgcattgttaccttatatggtggccaacgttatgacatccaacttcgtgcattaaaacaaggcgcacaagtggttgtgggtacaccaggccgtattcttgaccatattcgtcgcggaacattaaatctttctgaacttcgttttatcgtattagatgaagccgatgaaatgctacgcatgggtttcattgatgatgtagaaaccgtcatggcagaattaccagaaaatcatcaaactgcgttattctctgcaacaatgcctgaaccgatccgtcgtattacgaaacgttttatgaatgatccacaagaagtgaagatcaaagtgaataacgaaaatgccccagatatcgaccaaagttgttggtatgtacacggcgtgcgtaaaaacgaagcccttcttcgtttcttagaagtggaagattttgatgcagcgattatctttgctcgcactaaaactggtactttagacattacagaactacttgaaaaaaatggtttccgttctgccgcacttaatggtgatatgacacaacaattacgcgaacaaaccctcgatcgcttacgtaacggcagtttagatattgttgtggcaaccgatgtggctgcacgcggtattgatattgaacgtatcagccttgtggtgaactacgacattccgcttgatgcagaatcttatgtacaccgaattgggcgtactggtcgtgcaggtcgttctggccgtgctttattatttgttgaacctcgcgagcgtcgtttacttcgtaatattgaacacctaatgaaaaaaggtatcaatgaagtagaattgccaaatcatcttgtgttacaagaatgccgccgcaaaaaatttgtcgccaaaattacgaaacaactcgagcatcacgatttagaacaatatcgtagtttattagaagacttattcacagccgatcaggatcaagaaaatattgctgcagcaatgttgatgctgcttcaaggcaaacaaaaactcattcttccacctgatccaccaatggaaaaacgtcgtcgtgaacgtaatgatcgcggtgatcgccgtgaaaatccacgttcagctgaacgtcgtggcgaacgtaaaggctatggaaatccacaaccaatggatttatatcgtatcgaagtcggtcgtgcagatggtgtagaagttcgccatatcgttggtgcgattgctaacgaaggcgatattaacagccgttatattggtcatattaaactttatgatgattacactaccgttgaattgccacaaggtatgccgaaagaattattgcaacaattcgctaaaacacgcgtattgaataaacaaatgcaaatgtctttcttaggtgcagtaaaatccgataattcccgtggcagcgatgattttaacggtaaacgtaaaggtcgtggtggcgatttccgtggagagcgcggacgtgaacgcggcaatgataatcgtggaaatcgtaaatttaatgaaaaaagtaaccgcacttttagcgacaaaccacgccgtgatcgtagatcatcattctaaaaataaatcgtctgatattttacatacacttagccccttgaacctcaagggggcttttattgtctatagtgaaagttttggctacaatcccataacttttttatataggaaaaatcattgaaaggtctttttttacgtattattactgctctagcgttattattttgggctattgatatggtgttcccatggcaatttttacgtcatactgaagaaaatcattatactgcaattcaagctaggggatcactttatgtaggaacaataaataaccagatttcttattttattaataaagatagcgaacgaggctttgaatatgaattagccaaagcatttgctgatactttaggcgtagaactcgaaatgaaaattttcgataatcaagagcagttatttgatgaacttgataaacacaatattgatttagctgccgcccaccttttataccatcctaaaaatgcggaacgtttccaaataggtcctgcatatcattctgcttcatggcaattagcttatcgaaaaaatgaaaatcgtcctaaaaatttaggtaacgtaaagaaagatatttatatctcaaataatttagcattagaagaaacgctaaaagaattacaaaaacaatatccacaattaatttggaaaagaaatcaagcacttactcaagaagaactattactacaactggctgaaggcaaaattccttacgttattgcaaattctattgatattgctgcaattcaacaaatcaaaccagagttagccattgcctttgatattactgatgaagcaaacgttcactggtatttacccaataacccctaccgcgatctacaaacggctttactcaattttatgaataatgccgaagaaacgggacttttagataatttaaaagaaaaatatttaggacatatttcacaatttgattacgtggatacgcgctcttatatgaacgcaattgaaaataccctgccacaattctcaccgctctttgaaaaatacaaaggtgaattagattggcgactactcgcagcagtggcttatcaagaatctcattggaatcctgacgcaacatcgccaactggagtacgtggcataatgatgctcaccaaaaataccgcacaacatatgaaaatcagtgatagaacagatcctgaacaaagtattaaagctggttcagagtatttacactggttgattagtcagcttcctgaaagcattgaaaaggaagaaagaatttggtttgccttagttgcctataacataggactcggtcacttaattgatgcacgccgtttaactcaaaatcttggaggaaatccagataattggttcgatgtgaaaaaaaatctgcctttattagcagaaaaacgctattattcccaactgaaatacggctatgcgcgaggctatgaagcccatcaatatgtagaaaatattcgccgctatatgaatagcatagtgaattatcatcgagtccaagaaaatcaaacaacgaatgataatgccaacaacgaaagtgcggttaaaaatttagaagaaataaaagaaaataaggattaataaaatgttaaaacgtaaaacttttcttaaaaagaaagctaatttacaacaaagttctttatcacgtaatctacgtttaagacgtttaaaacaccgcaaacaacaacaattttcgagacattcattacaatttgtcgtacaagaaatttgttgctaagtaatctatttttcttatcaaaataaagaaaaaataaccgcacttttttatgtaatttatatcattaaagtgcgatctttgttttacaataatcgtaaaatatattgtgaaattttatagattaatcaatattttattctaattttatccctaagtttccaattttcacaccgactagaccaatcgagacgggatcaaaataatcccctaaaaatttgaacaattcatttaactctgtaaaagaacgctgaatttttatttgatcctccactttacgcacaaattcatagcgtatgttattttccttcaaaataagctgttagagttaaataaatcgtttcaaagaaatggctttttgccccctcctctccgggatcactaatacgcacattccacgtattattaagtagaatttgaggctgttttgacatattttactccttgctatttttaacctaagaaaaacccgattataaagtttctgtaatcaaaaaaatttataatcgggcttttcaaatattttccctgggtgtttcgccttacgttggtaactgcctttccctttacgttttttctcaacacgctgacgaaataatttatcgcctagcaatgccatcactgcattatcttttatcacgcctcgagtgtgcaaataaacggtttcattttcaaccgcacttttttgtttctttctcataaattttccttaaaaaagccgcggaaggatttccacggctggtgtattatacatgcaaacgtttaaattacaaaatctcaagtacagtttctggtggacgcccgattttagctttatcgccattaataacaattgggcgttcaataagtgctgaatgttcacttatcgctttaaataattctgcttgagaaagatctaaattatctaaatttaagcttttatatagttcatctttcgtgcgcatcatttggcgaacatcatcaattcccaattttttggcaatgctttgtaattcattaacggaatactgcttttgcaaatacagttcaataatcggctgaatacctttattttctaataatgctagcgtttcacggctttttgagcaatgtgggttgtgataaataataacagacataggatttcctcttagtagctataaacactgtaaattttaacttataatggcaaaaaaatacttataggaaaagaaattatgctagaaatgttaaaaagctggtactcacgccgtttaagtgatcctcaagcgatgggactattagctatattattatttggctttatctccatttatttttttggagatttaattgcgcctttgttgattgctctagtactatcctatttacttgaaataccaatcaattttttaaatcaatatttaaaatgcccaagaatgttagcgacaattcttattttcggtagttttattggtctagcagcagttttctttttggtattggtgccaatgttgtggaatcaaactatttccttattaagtgatttgcccgctatgtttaataaatctaatgaatggctactcaatttacctaaaaattatcctgaacttattgattattcaatggtagattctattttcaattctgtgcgagaaaaaatccttggttttggcgaatctgctgtaaaactttctttagcctctattatgaacctggtttctttagggatttatgcctttttagtgccattaatgatgttttttatgttgaaagataaatcagaacttttacaaggcgttagccgtttcttaccgaaaaatagaaatctcgcatttaaagatggaaagaaatgcaacaacaaatttctaattacattcacggaaaattattagaaatactgattgtcactttaatcacttatattattttcttaattttcgggctaaattatccgctcttattggcttttgcggtgggtctttcagttctcgtcccttatattggcgcagttattgtcacgattcctgttgcattggttgctttattccagtttggaatcagcccaacattttggtacatcattattgcttttgctgtaagccaacttttagatggaaatctccttgtgccttatttattttctgaagccgtcaatttacatccactaattataatcatttcagtattaatttttggcggtttatggggattttggggtgtattctttgccattcctttagccactttagtaaaggccgtaataaatgccttacctcaagattaaataatctttgaattttaagtagtctatttcaattagagctttatataaataaaaaatagttaatcgtaaattttcgattaactatttttttaatttattctaaaagtaaattaactaaggtaattcatcaatttctttatctactttaggtgggatcatatgttcacgacgtaaaccaacatcgtatgcaatggcaatggcaacaaaaatcgaggaataagtaccaaatccaatacctacgagtaaagcaagtgaaaagttatgaatggaaggaccaccaaagaagaacaatgccatcacgacaactaatgtagtaaccgaagtaatgatagttcttgataaagtttgcgttaaagaaatatcaataatatcaatcgtatccaatcgtctaatttttcggaaattttcacgaacccggtcaaataccacaatactatcgttgatggagtaacccaccacagataaaatcgctgcgacaaaagtaagatcaatttcaatttgtaatgcagagaatacccctagcgtaataatgacgtcgtgcgcaagagaagcgatactgccaaagcctaaacgccattcaaaacgtgaccccacataaataagcaccattgctaatgtcgctaaagtcgcatataccgcaccttgtgctaattcttcaccaacatttgggccaacgaactcaatactgcgaatttgaatgtctttatctacattctgtagcatacttttgacgtgttcaccaatggtagaatcattattacttgcaggtaaacgaatcatcacatcctgaaccgatcctgtggtttgtacaattgggctttcaattccattttcgtgaagtttactacgaatttgttcaaggttagcggactgcgagaagtgagtatcaaataccactccaccagtaaaatctaagccccagttaaatcctttggtaataataaaaaatagagaaattaccatcaaaagtgcggataatatataacccaatttacgcactttcataaattcagtcaatgggaacgggagctttatcccattgatttcacggataaaatgtccgtctttatcttttgtaaaaagtttcatcatttcccgcctaaattaataattttttaagttgtttaccaccgtaaagggcattaactaatgcgcgagttcctgtaatcgcggtaaacatagaaatcgcaacaccaagtgaaagcgtaatcgcaaaaccttgaattgggcctgttcctaccgcgtatagaataattgcggttaagattgtggttaagtttgcatcaaaaatagaagtaaatgcgccgttataaccttcattaatggcttgctgaattgaacgaccattacgaatttcttctttaatacgttcaaaaatcaatacattcgcatctactgacatacctaaagttaaaacgatacccgcaatacccggcattgaaagtgtcgcgccgggtaaaatagacattaatcccacaagtaatacgatattaataacaagtgcaaaacttgcaatcacaccaaacattttgtagtaaaacaacataaaggcaataacagcaactaatccccaaagactcgcattaatcccttgctctacgttttgcgcacctaatgatgggccaattgtgcgttcttcaacaatttgaattggtgcaattaatgcaccagatttcaataaggtagaaagattatgtgcttccgcaatgctatcaacaccagtaatttggaaattagaaccaaaacgtccttgaattgttgcaacattaatcacttcttcatgcttttctaaaatagttttaccattttcatcttttttaccgttatctttatattcaacataaagcgttgccattggtttcttgtaatattttttagtggtctgagacataatctcgccaccttcgctatccaaggttacactcacttgtggcgtgcttgaatgctgatctaaaccagagcttgaattaataatatgctccccgcctaatacggcacgtttaaataatgcaacaggatgaccttggcgatcatatttaacttccgaatcagctggtaacatattacgagaaatagcatcagccgtaacattttgatttacgatacgaaactcaagtgttgccgttgcccctaaaatttcttttgcacgtgcagtgtcttgaacacctggtaattcaatcacaatacgctccgcaccttgacgttgaattaccgcttctgcaacacctaattcagcaacacgtttacgtaaaatcgttaagttttgctcaatggctaagtcgcgtgcttcatttaatgctgcagtagatagccctaaattaatactatcagcatcaggctcagtaatatctaatgttggatgtaattggcgaataattcgctcagctttagcacgctggctcacattagctaaggttatcaacgtaccaaaatgctcagtatttttaatggcagtatattgaattttttctttacgaagttcgccacgcaaactgtcttgtaattgctcttggcgttttacaagtgtggcattcatatcgacttccatcaaaaaacgaaccccaccgcgtaagtctaatccccatttcataggattcgcaccaaacatacttaaccaagctggagtggctggagcaagatttaatgcggtggtgtaattattgccaagacgttcagcaattttatctttagcaagaagttgatcatcggtattagtaaaacgagctagaattgagccattctcaagcacgatagatttggttggaagattattggttttaagcacatcttgaacttgtccaagcacgctagtatttgcttcttgaccgcgtgtaccggaaatttgcaccgcaggatcttcaccataaatatttggaagagaatataaaatcccgatggccacaataaaaataaccatcaaattcttccataatggataacggtttaacatagttttccttttcttttctaacgcacagagccacaatgcgtggctctggaaaataatttaatgttattcttaaagtgattttaatgaacctttaggaagaacgctcacaatgtagttacgattaatcgtaatttctgtcgtgtcgtttaacgcaatcacgatgctatcgctaccttcggttactttagtaattttgccgattacaccaccagcggttaaaacttcagtaccttttgcaagctcagacatcaattttttgtgttctttattgcgtttagcttgcgggcgataaatcataaagtagaaaattaaaccaaagatcacgaaaataaatagcgtggacattgggctttgtgcttccattgtgttttccttattaatttaagttaaaaattttgcgtaaaataccataaattgcttcattgggaaaggcgaactaagcccaatatcctacgttatggcgattaattttattttttcaagataacgataaattctttttccgaagcgtaatattgctcgaccaaagcaacagaattttcttcggcaaaaatagaaaaattttccaccgcactttcaaggtttaagatcaacattagctcatcatttttatccaaattttttaaggcttttttagcacttaaaagaggaatggggcatcgaagtgcggttaaattgagctgatatttcattctttaacttgacgacgagcactcatgtgcttgcccatttcagtcaaaatatccgcacttaagcattcacgccccatttcaaataacggctcttctaaggcaatatgacgatcataaccttgaataaagcgttcaattaaatgtttatcaatatcttgacgttgttcagaaataagctcttctaactgcacagataatgcattccaattttcatgcaaatattcgtgctgtttttctaattcatcaatggaagtttgtgtttgcggagccactttgactaattgagggaaaaaatctaattcttcatcatcgtgatgtaacggtgcggcacgattgaaatagcttaaaatctgctcaacatcatttaatacagcctgagtatagccgtgtttttctagataatcaggcaaaatgcttaactgacgacaaaaacgttttaccttgctatgacaggcataaagcatttcaataggttcattccatgtggcgaattgttgaggttcaagaatttgcataagatttcctttgttaaaaagtgcggtcaaaaaacgttttatttttctaccgcacttttattaattatgatttatccgctaattgtaatggcggaacaggtttgcccatgcgagcatagaattccaccacaaaatcatcaaaacgatcatcttcaatcgcttgacgaatttccgccattaaacgttgataatagcgtaaattgtgaatggtatttaagcgcgcacctaaaatttcaccgcatttatctaaatgatataaataagctttggtgtagtttttacaggtgtagcaatcacattcaggatctaacgggctggtatcatcacgatattttgcattacggattttgacaatgccgtctgtaacaaataaatggccattacgtgcgttacgggttggcattacgcagtcaaacatatcaatgccacgacgcacgccttccactaaatcttctggtttacccacgcccattaaataacgtggtttgtcagctgggatttgtgggcaaatatattctaaaattcggtgcatatcttcttttggttcgcctaccgctaaaccgcccaccgcataaccgtcaaaaccaatattgactaagccttctaatgatactttacgtaattcttcaaatacaccgccttggataataccgaataacgcatttttattgcctaattcatcaaagcgatcgcggctgcgttttgcccaacgaagtgacatttccatagattttttcgcataatcgaaagtcgctgggtaaggagtacattcatcaaaaatcatcacgatatcagaacctaaatcatattgaatttccatggatttttcaggcgaaaggraaatacgctcaccattaattgggttttggaattttacgccttcttcggtaattttacgtaatttacctaaactgaatacttggaaaccgccactgtcagtcaaaatcggacgatgccattgcataaagtcgtgcaaatcaccgtgtttacgcatgacttcttgtcctggtcgaagccataaatggaacgtgttacccagtaaaatttctgcacctgtcgcacgcacttcttctggcgtcatgccttttaccgtgccataagtacccactggcataaatgcaggggtttctacactgaacgtgccctgtggacgttcaaataccaagcgaccacgacgagcattgccgcttgttttatctaattcatacttcatttttgctccaacgaataaacagttcgaagattttttaaacaaaaaagcctgttaaaaaatacaggctttgtgatatcatattttcaatgctctttgagcagaggcggatctactaagatagtccgccagttgccgctgtcgggctatttcgtagatcctgagtttgttaatcatactaaggataaaaatatgactaaatttatgattaagttggtcatcattattctactttgcctgttattgaaaagtagcactggctattagtagttgatgccgacaagagatggttaccgccatctcttgttctttattgtaggtgctgactaattacaagtcaaacaacttattccaatcctctcacattagaatttttattaataaacatcgcatcgccataactaaagaaacgatatttttcttttactgcatgcttatatgcattcatggtatttttataaccagcaaaagctgaaactaacataatcaaagtgctttcaggtaagtggaaattagtaattaagcaatccaccactcggaattttttccctggataaataaaaatagaggtatcagaaaaataaggctcaattaaatctggattgccaaattcttccgcagaaagtgccgcactttcaatagaacgaacagaagtagttcccactgcaattacacgtttgcccgctttttttgttgcgataatcgcattacagacttcttgagaaacttccacatactccgcatgcattacgtgatcttcaatattttccacacgaacaggctggaatgttcctgcgcctacatgtaatgtaacaaattcaaaattcacaccctttgctttgagtttttcaagtaaattttcatcaaaatgtaagcctgctgttggtgctgctaccgcacctggtactttactataaaccgtttgataacattcttgatcggcttcttcatctgggcggtcaatataaggcggcaatggcatatgcccaatggtttgcaacacatctaaaagagcggttgatttatcacttaattccacttcaaacaatgcaccatgacgcgctttcattaccgctttaatgccattattttcgcctaatttatcttcccctaaaaataattcagccccttctttaggggatttcgatgaacgaatatgcgctaagaaacgatgttcatctaacatccgttcaactaaaacttcaattttcccaccgctggctttacgcccaaacattcttgcaggaataacgcgtgtattattaaaaatcaacaaatcgccttcatcaattaaatctaatacatcagaaaaagtgcggtgaaaaatttctccgttttcgccatttaactgtaataaacgacaagaaacacgatcagttttaggataacgagcaattaattcatcgggtaaatcaaagttaaagtctgaaacacgcataacaaaatttaggttaaataaaataggcggtaagtctagtttgaattgaaaatgatctcaagaaaaaatctcccctcggggaagataaaataaccagcaattatgctggtcatttgggattaattataaatttgcttttttagttgcttttacgtttacatcacaatttttaacgatgatgttatcgctagatttacctttttgaattaaatttacaggcacaacagaatcaaatttatctaacgttaagccactatctacattccaaacataatccccagaaacgaaacttgtaaagtcattttgtgatttatcacgagtaaaatctttcgcaataatgccatcgcccacacttaccattgcagcaactggttcttggttttcaaattgatacacagcagtcaccgtttgtttattgcaggaatatacaactgttttatcagtgattgttggaagtgtttgcatttcagctatttgcgcagatgattttgtcatttcaggtgcatcctttgcacaagcagataatacgactgcagcagcaaatgctggtaaaagtttagttaaattcattattaaatcctcttaattaatcccctatatggggtgctacttagatgctcttaattaaataaagttccattattgaaataaaaaaggtgggatctgccccaccttgtttatcaataaacgatacaattatgttgatttttaccaacgataccccaatttcacgcccacattttgctgtttgccgagttgcgaaccttgagatttagaaataaaagcagaaagttggaaatgtaaaatttctgcctttaatcccacttctttttgccaataacgcccaaatgattgtkgcaacatcgtgctatttacagtggtttgtacgttagcgtttgaaacatcaacataattgacaaagaaataaggcttaacgctgatattatttgtcggggtaaatgtataatcaactcgaatgccagcattatagcgattaaatgcaaggctcggtgtttgcactttcacttcttcagattgataattttcacgttcaataaaatatcgattaacacccaaataaggctgaatacccaattgccctaaacggaactgataacttgcattcactccataatttatcgcttttcgatgaatttttcggctttgttcttcagccattttactcgcactaattcccgcacccacatttacaccaaattgtaaatcgccccattgatattgggcaaaacccgacatcatcgttaatgtcgcgtgatttttaacctgttcgtcaaaggtattatctgaacggctatgcgagaaaaccgccccaattcgtccattatctaaggctttttgcaccccaatttgacgcaagtncgttttctgctgataagcacggaacgcatcagaatcatagcgtcttttatcctgtgcgatatttgtccacagggcagattgtgcttgatctacaaaaagacgatccaattcatcttgaacggaaaacatactatttactgttgcagacaactccgataacgcactatttgagtaacggctgatcaattctttttgtttgccttgttcctcttgatcttgaggttcttttttcacttgcggttgggcattaataacctcaagtttgacttcgaatacctttaactggcttagatcaaacggggtatcagaaaacgctgcactcaatgctctttttgaccgccctttttttgtttttggcttacttgtttgtgtttcagtagtctgttcaacttgtttggcttctaatgcgtttaacaggctttgagcagacggggtatcagacaacaccgctcttcttgaccgcgcttttgccttacttttttgtttttcagcagtctgttcaacttgtttggcttctaatgtttgttctgcttgctctgctcttactaaatcattgagcaattcctgctcttttattgggttatgcaagcggaattcgcccttattcttcactaatttataacgtaatgcacctgcatcaacgtggtcattttctaaagtaaatttgagcttatctgataacggtttattatctaagctttcaatcaaagttaattgctcaagggtcacaggttctttgcctgtgttgcgaacagataatgtgtaatcgccctcagcgtcattggataattttaatttatcgcttttatagccaaataaagatgaagtaaattggaatgtgccttgcccgctcaatttaccatttactgtcaatgtgttgaaacgatgttctgccgatgttggcgttgtttccgtctctaatgaacggcggtgacgtggcgcattatttgagctagctgaataagctgaatttaacgtaacagtactattatttagcgttaaattctgcaatgtagtatcgctaggcattgtccaagtcgcattttccaacgtcactgttgtgtctttgtcgccctgaatttggtgccaaaaatggctgttttttaaagaaaattgagcagaatccgttaaatgcacattgccgtttaacgtggcattatttaccgttgcatttgcgtgatttgaaagtttgatattgcctgtttgggtggcattgttgctcaatgtaaattggctgtgatctattaaagtgacattaccattaagttttgctaaaccatgaatattcactgttgcattattagttaaattaatagagccattaatttgtgttatgggtatggaattaataacttttgtatcggttaaattaactgttttacaagtcgttaatcctgtccaatctgaacgcgtgcaaatggtattttgttaatttggcacaacaccaaatgtggcatttgcattattgctgactgtccaatttccctcaattgaagaaacattgcgagaaaccaccgcacttccgcctttaatttggaagttttcagctttaaatgtacggttgawccaatcgtaatcccacacaatttcgccttgtgggataccttccatttctgaccaacgtttgtctaaatgattgtaggcgtggggtgtcggtctaccgctgaaaaatagtttaccttttgtttgggtaatatcgccttttaagtttgtgccacctgaaagtagcaaagtacgatcttctgtggttggtttataaataaggtttaatcgtccattgtgtttatttttatctgtttcgccaaaccaaccgttgtaggcaatttctttgctgtaatcaagtttattaatattctttttattagatggagcagtaatactttcgttcccagtaatagtaatattagcgacttgagttgtattatggttcacaatcatcgcgccctcgtccgtattttggatacgcttaaaggttaatgaatgcccgttaagatctaagcgaccaccacgaaatccgaaatagatattgttaggatcaacttgatctgtactatttaattgaactgttgctcgaccgcttacaatgccaacttctttgaaagcttgtttttgacccgcttcatctgcttgttgatctagaatgactttgccgttacccgcacttaaacttcctaaattctttcccttaccattgactaataaagtgcctataccaattttagataaacgatcattttcaggattgtgaactttccattcaacagttgcatcttgtccaatagatacgcctgcaccttgccaagttatattattttgcttgccttttacaacaaaattaccttcaaagtataatccaccagcaccttgatttatattattttcgattgttaaagttccttttccttggtcgccaaggtaaatattttttccatattccattcttggttggtaaatattatagcctgctgctgctttaacatgttctttagcggtttgatttaacgatggattaaataacttcacagttcctacttctgattttgctttagagccatctttactaggtctagttaaagttaatttacctgtaccatcattatttgatacaaaggaataatgtccatttattgggggaatatagcgttgaaaaacactaggggtatcaaccgcaagaacttcattataaaaccattcttcacgtattaactgaaacccattacctcttccgaaaaaaggatgcccagtttgtaatacagcatttataagccattgtttcttcttcgcatcataaataaacattggcgaaccgctatcgcctttagaaccacccgttggtaatggaccataatgattagggctaactacattaccactaagattgactgtaccattaccatttccactctgagtatgggtatttcctgcagtaagataacgatatgcacctgagacataatatgaactatgtacattcgtttcttcatctttatctgtacgccaatactgacgtcctgagcctatacgtacacgctcaggatagttctctctatcagcatatacttttccatccatatttgttgtcatacccacaggttcagcttcagttacaaatttatgtaaacgaggcatatgataatctccatcataaggatgctttctctcccaagcttgataattatttctttttacaatttgataagtaaagcggtgctgatcagggtttcgtccttctgcaccaaaatcaacatcgttatatccgccgttatgtgccacgctcacaatatactgatcgcctactaatgccgccacgccgttacgcgacaccacggaaaaatcaatcatcggggcttttgtcattgatgtgccaactaattgcccttctttgttataaacctcaatatttttagccccaactgtgaacttccctttattctcggcaaaatcacgataatattggtagtcaatcccaaaataagtatgacctgcccaggcttgtgatgctatccctaatgaaacacaagcggttaaaaaattaagacgaaatacagtttttttcataatgtttatttaattaagtaatttttcgtattaaaaaatacgtggttaaacgactattgaacaataaaagtgcggtgattttctaagggatttcagctaaaaaacgaactaaaaggcacaaaagaaaataaagcagtaaaactatatagtaattaagccaaaatttctaggttttggcttaatacttagtgggtaatcttatcttgcgatggattaatattatatgtcatttatacagataactaaaattaaaacaatatcactaataaaataaccgcactttatgtgagttttctctgaaagtgcgatcattttttctaaggtttttctaaaatcggtttaaggaagcgagcggtgtgggaacttgttactttagcaacttgttctggtgtacccgtcgcaataatttgtccgccgccactgcctccctctgggccaagatcgacaatccagtctgcggttttaatcacatcaagattgtgttcaatgacgacgatagtatttccttgatcgcgtaatcgatgcaatacttcaagtaattgcttaatgtcagcgaaatgcaaaccagtcgtcggttcatctaaaatatataaggttttacctgtatcacgtttagaaagctcagtcgctagcttaacgcgttgtgcttcgccgcctgaaagtgttgtagaagattgacctaatcgaatataggataatcccacatccatcaaggtttgtaattttcttgcaatcattggaatcgcatcaaaaaactcgcgtgcttcttccaccgtcatgtccaaaacttgatggatggttttacctttgtaacgaatttctaaggtttcgcgattatagcgtttacctttacattggtcgcaaggaacataaacatcgggtaaaaaatgcatttcaactttgagtacaccgtcgccctgacaggcttcacagcgtccacctcgtacgttaaagctaaaacgccccggattataaccacgcgcacgtgcctctggcacacctgcaaaaagttcacgaattggggtaaataagcctgtataagtggctggatttgaacgtggcgtgcgcccaatcgggctttggttaatatcaataactttatcgaaatgttctaatccctcgatagattgataaggtgcgtaatccgtcttttccgctctatttaacgcattttgcgcaagtggaaataaagtatcattaataagtgtggattttcctgaaccagacacgccagttacgcaagtaaacaaaccaacgggaatatctaaattcacattttttaagttattacctgatgcgcctttaagtttgagccattttttcttatcaagtgcggtgcgttttttaggaatttcgattttatctgcgcccgataaaaattttcccgtgatggaatttggattgagcataatttcatcggcatttccttgcgcaataacttgtccgccatgcacgccagcaccaggcccaatatcaataatatggtcagctgcacgaatcgcgtcttcatcgtgttccacgacaattaccgtattaccaagattacgcaaatgaattaacgtattaagtaagcgttcattatcacgttggtgcaagccaatagagggttcatctaatacatacattacgccaacaagtcccgcaccaatttgactcgcaaggcgaatacgttgcgcctccccacctgaaagagtttcagcagaacgagaaagagaaagataattcaaaccaacattgactaaaaactgcaaacgctcgcggatttctttaagaattttttccgcaatttgtgctttttgaccagtgagagaaagtgcggtaaaaaattcgagggtttcgccaatgcttttttccgcaattatcggcaaattggttcttccaatatacacattacgcgcttcgggtcgcaaacgagaaccgccacaatctatacaaggtcgattgctaatatttttcgctaattcttcacgcrccgacattgattccgtttctttatatcggcgagccatattattcaaaatcccttcaaaagggtgcttgcgaataaccacatcgccacgatcattcatatattggaattcaatttcctctttgcctgagccatgcataatgatgtgttgaattttctttggcaaagattcataaggggcttcaacatcaaaatgataatgtttcgccaatgatgtaagcatttgataataatagaaattacgacgatcccaaccttttaccgcaccaccagcaagagaaatagttggattttgcaccacacgatcttcatcaaaatattgctgcacacccaagccatcacaagttgggcaagcacctgcaggattgttaaaggaaaacaaacgaggctctaantctggcacagaataaccacaatgcggacaagcaaaatttgccgaaaaaactaattcttctgctttcggattatccatttctgccacaattgcagtgccacctgaaagctctaatgcggtttcaaaagactctgctaaacgtgttgctaaatctgaccgcactttaaaacgatcaaccactacttcaatagtatgttttttctgtaaggctaattttggcggatcagataaatcgcaaatttcgccatcaatacgcgcacgaatataaccttgcgcagcaatattttctaaaatcttaacgtgttcaccttttcgatttttgacaactggcgcaagtaacatcatcttgctgtcttctggcaaacttaatactttatccaccatttgactaattgtttgtgccgttaatggaacattatgatcgggacaacgtggctcccctactcgtgcaaacaataaacgtaaataatcataaatttccgtaattgttcccaccgtagaacgtggattgtgtgaggtagatttttgttcaatcgaaattgcaggggaaagtccctcaatagaatccacatcaggcttttccattaaagataaaaactggcgtgcatacgccgaaagagattcaacatagcggcgttgcccttccgcataaagtgtatcaaaggctaaagaggattttcccgaacctgaaagcccagtaatcaccacaagtttattgcgtggaatagttaaattaatatttttcaggttatgggttctagccccgcgaatatcgatattttccataaaataactcaaaagtatgaaataaatgtaaattttgcgatcattatcgcatattttaatatctgtgcaaatatccagttaaaatatatagatcttttaaaaaatttcaggcaaaataaccgcacttttttagataaaaaatgaggtttttttatggctggaattaataaagtcattattgtaggtcatttaggtaatgatcctgaaattcgtactatgccaaacggcgatgccgttgcaaatatcagcgtagcaaccagtgaaagctggaacgatcgtaatactggcgaacgccgtgaagtaacagaatggcaccgcattgtattctatcgtcgtcaagcagagatttgcggcgaatatttacgcaaaggctctcaagtgtatgtggaggggcgtttaaaaacgcgtaaatggcaagatcaaaacggtcaagatcgttacaccacagaaattcaaggcgatgtaatgcaaatgcttggtggacgtaatcaaaacgcaggtggttatggtaatgatatgggcggtgcgccacaatcttcttaccaagctcgtcaaactaacaatggtaatagttatcaatcatctcgcccagctccacaacaagctgcaccacaggctgagccaccaatggatggatttgatgacgatattccgttctaaattacatagattgaaaagtaaatgataaaaatcaaagagaagctgaataaaagagagcttctctttttattttactaattaaaaggactaaacctatgattatagatttagtccttaattttatagctttagttttagggaagattaattgctaccatttatcttccatatcacattttattgaagagtaaaactaatttgcacacttaaactcgaaggaaatcctgcgggtcttgttccaacagagcgagatacgttaatagcgtctaatgccgccttatctaaactttcatcgcctgaggattttgtaaccttagcaccacttaacgaaccatcagctcctacattaaaagatacactcacttttccttgtttgcgcattatcttcgctcgagttggataacgtttatggctttcaatttcacggcggattgcagaacggtaagccgctatttcactcgtatccgttccacttcctgctacctgtgcattgctattagctgcgcttgtngtacttgctttatcatttacgttggcacttgaatcaatattttcatcgccttttggtagctctttattgattggtttcttttgtggtttaacctcttttttaggtttattcttcggctttccttttggttttcctttgggttttggcttttccttttctggttctttgatttttttcggttcaggttttattgttggatcttctacaatttcttgtttttctggttctggctctttttgtacatttcctggctctggctctggctctggctctttttgtacatcttctggctctggagcaggttcttccaacaccatgccctgtaatagctccatagaaatacttgtagatatatcgccttgtgcactatttgcgctatcacttggctcattccaattccataagataaatcctataacaataccgtgtgcgatcaaagaaataagcaaacccaatagcgaacgttttgtttgctgcataattattccttacggcgtagttggtacagattgggaaggagtagattcttgagaatttttacccgcactttttcccttatctttcatagaaacaattgccacatttttgatttcatttttagaaagcatatctgtaatcgtcacaaaatcttggaaagaggcttcggcatcaatttttaaagttactttctgatctttattccattgagcaatttctgcctctagagcttcttgagaaataggtttatcattaaaatagagttgtttatccgctgtcactgtcaataatttagctagctcgtcagatttaaatgcgaccgctgtactagcttttggtacatttacttgaattttaccttgagagataaaagatgcagtaataagcaccacagtaagtagcaccaacataatatcaatgaaagggataatgttgatttcatcgaattttttcacgaattattccttatctttttgttcgcttaatactttccattttaaacgattaacttcaactttacgccccaaaccgttataaaacaccatagagggaatagccactagaatacctaatgcagttgcttttaatgctaaagataagtgcagcataattacacttggatcaatgtcgccaccgccgtgaccgatttgatagaaagttaataaaatcccgataactgtaccaagtaatccaacataaggtgcgtttgcaccgatggtagaaatcactgtcatattacggtttaaatcaatatctaatgcgtgaatagtagaataatgtgccacgcttacctttcttaaaaaaagataacgttcaattaccatcgcaagcataataatgctcatcagtaataataaaccgatgataaaataatcactgtactgctgtaaaaaatcaaaaagttgtaccattttttttccttgttatttgagaaatttctttgagaatataattgagaatgaatttcaatcatacgggggattttagcaaaggctaaataatgcgtaaaccttgaattgaaaaatttctgaattttttaccgcactttatgtggaaaagtgcggttattttttgaaatattatagggaacgaagataatcaatgatcatttgatgatggtcttttatcttaaatttatcaaatacttgcataatagttccgctttcattgattaaaaaactaattcgatgaataccgtcgtaagttctccccataaattttttttcgccccatacgccaaattgctccgcaacttgatgatcaggatcagaaagcaatgtgaaattaagttcttttttctcaataaattgagctaattttttcggggcatcaggactaataccaagtacaactaaacctagtacatctaattcggatttactgtcgcgcaatccgcaggcttgtgtggtacagcctggagtgagagcctttggataaaaataaattaaaacttttttaccacgaaaatcacttaaagaaacaaatttttcttgttgatttaataaggtaaaagcaggtgcttgattaccaacagataatggattcataaaaaactcctttaatgaaaaaaaatttgcaaattaacgttattttagcgactataacaagtgaaaccaaataataaaattaaaaaccgacggaggttatatgtcagcgcaaaattctttattttcgggtagcatagttgcccttgttacgccaatgaatcattatggcgaagtcgatttttcctgtttagaaaaattagtagaacaccacattgaagctggttctaacgcacttgtttctgtgggtacaacgggagaatccgccacgctaagtattgaagaaaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaacctgaaacagttgctcgtttagctgaaattgaaaatattgtaggcattaaggaagcaacgagagatgttagccgaatagttaaaattaagcagcttgcaggtaagaattttattgttttaagtggtgatgatgcaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctattcattgaatctaatccaattccagtgaagtgggcagcttatcgcttaggcttaattaaatcgccacatttacgcttgccacttacaacacttagtgaagaaattcaaccaaaagtaggagatgcgctwaaaatcgcaggattattataaaaataaaggggtaagtaattacccctcacttttatgtattatagatcagtaaaatgatcaaaaagtgcggtcagaatttatcaaattttcaatttagttaaggttaatatatgaaaaaaataatattgaatttagtaacggctattattctagctggttgttcgtctaatcctgaaaccttaaaagcaaccaacgactcatttcaaaaatctgagacgagcattccccatttttcccctttggctactggaggggtacagttaccaaaagctgatgattcctattcattacctaatattgaagtgaaaaaaggggaagatattgatattcgcccaccattaatccctctcgctattattcaaaattcaataacaaaatttgatggcgaacgctcgttgattgtctatccaaaacaacaggcaaaactatataatcttcagcaagttgagcgtttattgaaagaagagggtatttcatcaacaacagatggttcgattttaacgactgattgggcaaaaacagaacgaattggcgataaatctatagaaataaaatatcaaatagaacaagttatgacagctgatgtaagtgcgcttaccgtatctattttacatatgcgccgagatggtattatttttacaccaaatgtatcagataaacaatattatacttcggaacgtttaaatcgcattgttttaacactcactaccgcatataacaaacaattacgggatttatcaagcactttaattcaatagggcgtcatataataatttctctaaaataataaatgtttaaaaatgagacatagatcatccttttgaaaattactctgatatttatctttaaaacacttgaaaatctaaaataagaacactattttgttattaactagaatttaaatcacgcaacaaagaggtaaatgctatgacacttaatattaccagtaaacaaatggacatcactcctgcaattcgtgaacacttggaggaacgcacttgcgaagttaggtaagtggcaaacgcagttaattagcccacattttgttttaaacaaagtacctaatggatttagtgtcgaagcctctattggcacacccttaggcaatttattagccagtgcaacttcagatgatatgtataaagcaattaatgaagtggaagaaaaattagaacgtcagcttaataaacttcaacataaaagtgaatctcgccgagctgatgaacgtttaaaagattcttttgaaaactaaatactgtagataaaatctaatctggcagtcttattgtaaaataatatgtctgtcagattaattttagatgaaacaattaaatcactaaaaattgatgatattaactcaaaatattaataaattttattaaatatagattaatttaacctatcctgcacggcgatgtaaacttcagtacattcacgcttatccactacaagaacataaacgacaactttatcttcaataacttcataaacttaaacaatgccctaagagcgaaattttattttataaaacacaccaaaaaatctaaaaaaccgatcggcaaatacgtatgantttcctaagcgtttgattaattttttcttaaattgcttttaataaaaatagagactaatgaaagatacagattaaatttatattttttaacgaaatagatattatttgacgggattaatggcggtgagaaagggatttgaacccttgatgcagtttcccacatacacgctttccaggcgtgctccttcaaccactcggacatctcaccgtaaaaggtgagcaaactataaagatttactctggtttagtcaagttttttactctaaaaaataaaaatctttaaaagattagttaaaaaataggcaataaaagctattgagctaattcagagttagaagatactaataatttagtaagatgtaaccttgataattattaaaacagttgattttaatagataccatatattaattatcttttattctctttcttaatctttttattttaattaaaaaagggattttctcaaaatgatcataccaagatgatggtatatcaataattttatccatttcttttaaaagtaaatttcctatatgacaatttaagtgactgcattttttgtgccaaaatttatttggaccacaataatgagaaataactattggcatttttacgcataataaattttctttttaatcaaatctcgatccgttggtgtaaaattaaatctattattaataaattttacttttcctttacagataccatttagaatatcttgatcttggtatttcataacattattgtatttatcatccaatttattgatttttggaaaatattttcttctttccatttatttaaattaattaataatatgcccgcattaaaataagaatatccttctaaaccaattgtttttttataagcttcattttttacatcaataaaagtatctcgacatgctgccaaataatagttcgttatatctatattccaaagttcttgaagtgaagagtttgttaatgtgtccacatcaatataaatagctttttctatattctttatgtatttagttaaatttagtctagcgtaagtagccaaagatatataatctattgtttttggaaagttttgaaaatctgactcacaaacgggcaagaaaaatactttacaagaatatgcgcttgctaaattatttattatggtcttattttcctgatttattttcatatcaagantataaaaatttatttttttaggtgtatttttaataatactaaaaatacttacagctaaataaggggcataatagtggtcagacgaaaatataatattcattgtctgactgacagtccgtccgtctgtctgtctgtctgtctgtctgtctgtctgtctgtctgtctgtctgtctgtctgtctgtctgtctgtctgtctgtctgtctgtctgtcatgaaattatctctgattaacgtgtgaattattattttttgggttatttttttgatagattaaataattttatttactttataatttactttttaaaacactcaatgcctttgctcgatgagaaatttttttcttctcagctgtttctaattcagcaaatgtgcaaccttgttctggactaaagaataaactgtcataaccaaagccattttcgcctttttcttcaaaaccaatcacgccacaacactcaccttcggcgataattggcgatggatccgttggatgctgtaaaaacacgatacagctcacaaatttggcttggcgttgttcttgtgcaatatgagcaagctctgccaataatttctcacggtttttagcatcattgccctcttcaccagcataacgggcagaatacagacctggtgcgccattaagtgcggaaactactaagccagaatcatctgcaatagcaggtaaacctgatttctctgaggcataacgggcttttaataaggcattctctacaaaagttaagcctgtctcttctgggctttcaatgcctaaatctgtttgtgcaatcacttcaaagccaaaatcagataggacatcagccatttcttttacttttcctttattgcctgtagcaagtacgattttttgtttcataattagtccttttattgatgataagctgacgttaaatcagcccagttttgctcggtaaattgaatattcattcgtccaacttctttttcgaaggaacgttttaaacggttcagattttgcactttccaaaaatctgcagatttttcgccgcacttatcaaaatccagtaaccaacatttttgcccttgttcagtttgttgaagcaaaatattatgtgcattcaagtctgtatggcaaatctgtaaatcatgtagttttcgaatcaaacgaccaatttgcatccaagtttcttttggcaatgtttgtgtttgtaaaagtgcggttaaatcctgcgcgttttcgattttttccgtcaaaatatccgcttgatagcaaatacctaacttgcctttttgaatacgtgcggcaatgggtttaggcacaggtaaccccgcttcatacaaacgttgcaacaaatgaaactcagcaaaactacgggtagtttcaagagcagaaaaacgataacgatctttgttcagtttaccccaaagtccgccgcgataataatgacgcaacgcacaatttacaccaaaccaatcttcagtttgcaaaaaataagtgatgcctcgaccttttgcacttcctatcactcgttcttgtttttgccaaaattccgcttggaaaaactcggttgcttgctcaaaagtgcggtcaaaattaaagataaaatattggttatcttgttggaattggtgcattggaacgttgttatgaatagaaaatggacttattctactttaaaataagcacaaattaaatgataaaggaacgtcaatgccactttttaccgaagctccaaaatccctttgtattctccgattgtcagcggtaggcgatgtctgtcatgccttagcggtggttcagcacattcaagaatattatccccaaacagaaatgacttggattgtaggaaaaaccgaaatgggtttgctttcaagtattcctaatatcacgcttattccttacgataaaaaaacaggatggaaaggcgttttatcactttggaaacaactaaaaaataaacagtttgatgcgctattaaatatgcaaacagcatttcgtgcatcaatcctttctttaggaattaaagcaaaattcaaaattggatttggagaaaaacgttctcgcgaagggcaatggctatttgtaaatcgtcgcatcagagatcctttttcccctcacgtattagatggatttatggctttcgctgaatatattggcgtgccgaaagcagaaccgaaatgggaattagctatctcacaagatgattataaatttgccgatcaatttattgatttctctcgtaaaaatttattaatttccccttgttctagcaaagcagaaaaagattggctaatcgaaggttatgcagaggttgccaatattgcccatcagcataatatcaatgtaatcttctgcagttcaccagccaaacgtgaattagaaatagtcgaaaaaattaccgcactttgccatttcacaccaaccaatattgcagggaaaacaaacctaaaacagcttaccgctttaatttctaaggttgatctagtactttcgccagattcaggccctgcccatatagcgacaacacaaggtacacccgttattggcttgtatgcctatcacaatcctttgcgtactgcaccttataataatttagataacgtggtatcagtatatgaagaaaatgcccaaaaagaatttggcaaaccgtcatctgaactaccttgggcaacgaaactaaaagggaaaaatttgatgacagagattcaagtggaacccgtcattggacaaatgaaaaaattggggttattttgaaaaaataatctgtatctcaaaacttagatggttttaatatagccaacttgaaagttgtttttggaaagtaaggactttagtttttttaagttaaaaatcaataacttgctgtcaaaataattatatttagtcataaaaatctataccttaatctctcgcttatttagtccaatttttgcaggtacagattgaaatccaaaattagtttgaattttacgcaattaaattcaaatgattataaataaaccaattgattattattattattattattattattatcgccattctcctctttttaattattacaataaggaaaacagatgcgattttctaaactttcccttgcaattacaacaaccttagtgacagcaaatgcgctagcgcaatccgttgaattagactctatcaacgttattgcgacacgagayccaagtaggtttgcttatacgccagaaaaacaatctaaagatagtcttctttctaagcaagcgactagtgttgcagatgcgttagaagacattcccaatgttgatgttagaggcggttcgagaagcattgctcaaaaacctaatattcgagggttaagtgataatcgtgttgtgcaagtcattgatggcgtgagacaaaattttgatttagcacatagaggttcttattttcttccaatgtcactcatccaagaaattgaagtaatcaaaggaccaagtagctccttatggggtagcggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcactggtaaaggcaacaagctaaataataccgcctataaacagtttgggggcttagcaaaattcggttggcaaattaatgatgcgaaccgcgtggaattatcccaccgcgaaactcgttttaaacaaacagcaccaagcaataatgaggtggaaaacgaacttactaatgaacaaattacagatcaaatcaaaaagttccacggacaaaaagacgatcttcttcctcctacaacacaaccatcaccatcagaaagatcagagttttactctaaagtgaaaacacgtttaggtagtgtcagttatttaactgatcaacaaattcctgatcaaagcacggtatttaactattatttaacgccagataatccttatctaaatacgcatatcgcactgtataacaataaaactattgagaaagaacagcgtaaagtcagtggtgtgaaagatcagactaaattgactacccgaggtataaatttacgtaattcttccgaattatctcacatttcctttgtttatggggtggattatatgcgagataaaatccgtaccgaacgaggcacaaacggtagcgatgcgaagtttcgagcggacccctataatgcgaattcaaacactacaggcgtttatttaatcgcccatattccgctatttggggaaaaattgctagtttcgccaagtgtacgttatgaccactacgatacctcaagtaaaaccgtaaaatacaaggataatcatttatctcctgccacaaaattaacttggatagtgaccaattggttagattttactgccaaatataatgaagctttccgagcaccatctatgcaagagcgatttgtgagtggtgctcactttggggcaaatactctagggctagatcacatcaatagatttgtagcaaatccaaatttgcgccctgaaacagcgaaaaataaagaaattaccgcaaatctacattttgatagtctgtttaaacaaggcgataaattcaaaattgaagcgacttatttccgtaatgatgtgaaagattttattaacttaaaaatatttaatgatgcaaagacaagtgcaagtgcaggtgcaaatccaaatacaaatggagcattgttgccaaaaaattcccagtatcaaaacataactaatgcccgtttaagcggtattgaattgcaagctcaataccaaacagaacgtttaacgctatttactaactatggcagcaccaaaggtaaagataaagatagtggcgaagctttatcaaacattgccgcaagcaaaatcggcgtaggggtaaattatgctttagtaaaagacaaattcacggtgggagcgacagtaacccattacgctgctcaacgccgagtgcctaaagatcatagtgttacctacccaagttatatactgaccgatcttcgtgctacctatgcaccattaaaaggcgaatggaaaaacctgcgtttagattttgcactggaaaacttgtttgatagaaaatatcaacccgcgtttagtttaatggaaggcactggtcgtaatgcgaaaattagtgcggtttatagcttctaaatttactttggaaaacgccctaaagctgttttccctcaatttttgtaattttatcaattaataggacataaggaatgaaaatgagacctcgttattctgttattgcaagtgcggtcagtttaggctttgttttgagtaaatcagtgatggcattagatcggccagatactggatcattgaaccgtgaactagaacaacgtcaaattcaatcagaagccaaacctagtggcgaattatttaatcaaacggcaaattcgccttatactgcacagtataaacaaggactgaaatttccacttaagcaagtacagattttagatcgaaacaatcaggaagtcgtcacagacgagcttgcacatattttaaaaaattatgtaggaaaagaggtatcgctgtcagatttaagtaatttagcaaatgagatcagcgaattttatcgtcataataattatttagtggcaaaagcaattttaccaccgcaggaaattgagcaaggtacggtaaaaattttgttacttaaaggtaatgtaggcgaaatacgcttgcaaaatcacagtgcattaagcaataaatttgtatcccgtctctctaatacaacagtgaatgcgtccgaatttattttgaaagatgagttagaaaaatttgctttaacaataaacgatgttccaggggtaaatgctggtttgcaactctccgcaggcaaaaaagtcggcgaagcgaatttactgattaaaattaacgatgcaaaacgtttttctagttatgtttcagtagataaccaaggcaacaaatatacagggcgttaccgtttggctgcggggacaaaagtcagtaatttgaatggctggggcgatgaattgaaactggatttaatgagttctaatcaggctaatttaaaaaatgctcgtatagattattcctctttaattgatggttattctacgcgttttggtgtaactgctaactatctcgactacaaattaggtggtaattttaaatcattacaatctcaagggcattcccataccttaggggcttatttgttgcacccaacaatccgtacaccaaattttcgtttaagtactaaagtgagctttaatcatcaaaaccttacggataaacaacaagcggtttatgtgaaacaaaaacggaaaataaatagtttaactgcagggattgacggttcttggaatcttattaaagatgggacaacttatttttcattatctaccttgttcggtaatttagcgaatcaaactagtgaaaaaaaacagtatacaaaagaggattttcaaccacaatcgcattttacggtatataactaccgcttgtctcacgagcaaattttaccaaaatcttttgctttcaatattggtataaacggtcagtttgccgataaaacccttgaaagctcacagaaaatgttgcttggtggtttgtctggagtacgtggacatcaagctggtgcggcttctgtggatgaaggacatttgatacaaacagaattcaaacattatttaccagtcttttcccaaagtgtgctagttagttcattgttctatgactatggtttgggaaaatattataaaaatagccaatttctcgaaaaaggcgtgaaaaatagcgtgaaattacaaagcgttggtgcaggactttctctttcagatgctggcagctatgccatcaatgtcagtgtcgccaaaccgcttgataacaatattaataatgccgataaacaccaattttggctttctatgattaaaactttctaaggaggtatgcaatgtataaattaaatgtaatttctcttatcattttgaccacttacactggtgcgacatatgcctctgcacgggatttgccacaaggtagcagtgtagttgttggggaggcaaatgtttctacaattggaaataaaatgacgattgatcaaaaaaccccaacaactcaaatagactggcatagttttgacatcggtcaaaataaagaagtggaatttaaacagcctgacgcaaattctgtggcatataaccgtgtaactggcggcaatgctagtcaaatccaagggaaattgacggcaaacggtaaagtttatttagcaaaccctaatggggttattattacccaaggggcagaaattaatgtagctggtttatttgcaacaaccaaagatttagagagaatcagtgaaaatggcaatggcaatggcaataaatttacccgtaaactaaaagacggtcaggtggtaaaagaaggtcaagttatcaataaagggaaaattaaggcgaaagatttcgtggtacttaatggcgataaagttatcaatgaaggggaaattgacgctacaaacaatggcaaagtatatttatcctcaggctataattttacatttaccttatcagatagcngcataagtgtggcattagaagataatgcagtacagagtattgttcaaaatgaagggattattaaagcaggggacattacgctaaatgcaaaagggcgtaatcaagcattagatagcttggttatgaataatggtgtgttagaagcaactaaggttagtaataaaaacggcaaggttgtgttatctgctgacgatgttcagttgaataataaaagtgatattaaaggggagagtgaggttgtatttactaacgaacctaaaaacaagataaaaatcacttctcaaactggctcaaaagttacctcgcctaaaatcaactttacaggcaaaagcgttaatatcaatggtgactttggacgtgacgatagtaaagcgcactataacgaagagcataaaagattagatacagaagttaatattgacgtgccagacaatgaaaatattcgtattgcggagaaagataatacgggcacgggtacgggtacggattcatttatacaaacaggggcgttaagttcattactagctaataatggaaaagtgaatcttaaaggaaaggacgttaatatttcaggacgtattcatatagattcctttagaggctcagattcgctattaaagctaactaaccaaggtcatattaagatcaatcatgcggatattcattcaacaggtcgtttattttttataaccagtttgcagaatgagaaagattctcaatcagatattaccattactgacagcaaaataaatcttggtaacggagctatgggattggggcgtagtctcgataaagaaaactgcgataaccaaagatggtgtagaacggaaacctcacaacgcaagaagtttgatgttcatatgcgtaatgtagtatttgatcaggttgatgatgtggttgtagcaggtggatttaaaaaagttaatttagataacatcgttgccacaggaaaaacgaatttttacattgatgggggggtatcccgtaataattcaagatatgaatacggtgtgttagatttagacaaacgtacgctgttatcggagttagatcaacgcagacgccgttggaaatattacaatgatttagatttagatatgaataaagcttattggcatcgttttgatatgtttgccactaaaaatacagggcgatcaactattaaagacacagaaattaatatttctaacagtaagattaatctgaaaaatggatttgtacatttactggcagaaaaaattaaattagataatagcaagattgatattacttttgataaagataattcacaagatatttcaactcaaattaaccgtttaggaatgaatggtaaagtgtcaatggtaaactcacatattaaaatcgtgggcgatgagaaaagcgatatatctgcaaaagcaccttatgctacgatgtttttaatcggggaattaataggggaaaaaagttctatttttgtgaaatctcatcagggttacacctttagaactgatggtgatacaaaaattgcaggtaaaaacagtaaagatgacttgaaaattaccgcaattaacactggaggaagaactgggaaagaagtgatcattaatggtgcgcctggctcaattgataatgatgcgaatattgccaatatggcatttactattggtgataacgcaaataccaaaacaaccattgaaaatgccgacatcactgccttagcaccaaacggtgggacagcttatttaagctccaaaggggtagaaattgaggtaaacccaaattcaaatttcacattctttgaacttcctcgtgagaaaaactttaatcaaacaaaaattaaaggcgattctaccaaactcagtgaacgtggttttgctagactttatgacaaaattaacggtgtgcgagccagcaacttgtctgctgagcaattgaatgtgacggacgcaagcgaaaaaatcattaatacaaagttagtgagtagcttagatgttgaaaaacttgtttctgttgcagtttgtgatgcaggtaaaggttgcgaagaacaacaattcggcgataaaggtaataatactaaagtgagtgttggagagttagaaactgaacaataactattcagaacacaaggtaaaagcataaagccaatctgacagacatcaattaaattgcatgcctgtcagatttattaatagccactatcgctacattattttaaacaaccacgaacaatcaatacgccaacatttcgagcttgagcgacggcttttggtttactcagtttaatttttaatccttgaagttgataacgtgactcaagcaaatccgccacttcataagccactcgctcaatcagcaagaaaggtttgctttccacataatcaataatcgcttgactcacttcagcataatttaaacaatatacaacatcatccgtttctgccgcttgtttgcaatcccaagccatttccaaatcaaacacaagtttttgctttatttgctgttcccaatcatatacaccgatttgtgcaaaaacagtcaattcttcaataaaaacacgatccataaggtttcctctaaaattattgtaggcgtatgctatcaattttgggtagaataacgaacagtttttcttgctggagtgcaaaatgagccttttcgcccttttttatatgctttttgcctatcttttaggctcaatttccagtgcgattttaatttgtcgcattgcaggcttgccagatcctcgtcaaaatggttcacacaaccctggggcgacaaatgtgttgcgcattggaaatcgtaagtctgccttggcggtgcttatttttgatatgttaaaagggatgattcctgtatgggcagggtattatttaggtttaacccaatttgaattgggaatggtcgcacttggtgcttgtttagggcatattttcccaattttctttcaatttaaaggtggcaaaggtgttgcaactgcctttggggcaatcgcaccgatttcttgggctgttgcaggttcaatgtttggtacgtggatctttgtttttcttgttagtggctattcttcattaagtgcagttatttctgcattacttgtgcctttttatgtgtggtggtttaaacctgaatttacttttcctgttgcactggtatgttgcctattaatttatcgtcatcacgataacattcaacgcttatggcgtggtcaagaagataaagtttgggctaaatttaaaaagaaataaaaattttaccgcacttttctaaatttccactggagtttcctgtgtatactaaaggttccgtttccactcgtattgcgaaatatttatttatcattcttatcgttgctggtgtgattagttctctcagtttggcaattatgagcagtaataaatatgatgccgaagccattaatatttcaggttctttgcgtatgcaaagttatcgcttactttatgaaatgcaagaacaaccagaaagcgtggaaacgaacttacgccgttatcatataagccttcattcatctgctttactagaagttcaaaatcaatttttcacaccgaatgtattaaaacattcctatcaaaacattttgcaacgttggacgaacatggaaaaatatgcgcgccaacaggatgtaaaaaactatagtaagcagcttactgactatgtggcagatgttgattattttgtgtttgaattacaacgttttagcgagcagaaatggattttaggcgtttcagtattaggttttgcgatgttgttaattttgctgatggtgtcttatgtgatttggtatacaaaccgagaagttgtgaaacctttgcatttaatgacaaaagccagtatgcaagtgcaaatgcgtcaattcaatcatattccacttgacacaaggaaacaaaatgaacttggcacactggctcgcgtatttacacaaatgtccacagaactgggacagctttattcgcgtttagaagaagcggtaaacgaaaaaacgcaaaagttgcgtcaaactaaccgcactttaagcactctttatcaaagtgctcaacttctgaatacaaacacaattaacgataaaattttaaatcaagttttaaattacatttttattagcgaccatttgaacttcgttaaagtggaagtgatgggggctgaacattgggatattacattgggtaagcaagatgctaataatgaactacaaatcgaaaccctttctgtggataacgaagaattaggtgtactctcttggcaagcaggattaccttgtccagatccccgaattatgcaaaatttagcgcaaatgcttgctcgtgcgctttatttccataaaaatttacgtcagaaagaacagcttttattaatggaagaacgctcaattattgcgcgagagttgcacgattctttggctcaagtcttatcatttttacaaattcaacttactttgctcaaacataatctgaagaaagaagacgaacaatcaaaagaaaagagtttggcaattattgccaattttgaacaagccctttctggtggttatgcacagttacgtgagcttttagccactttccgtttaaccatacaagaagcgaatttacagcttgcactaaaacaagtgattgattcattacgctcgcaaacaacaatgcaaatgaatgtgaattgtcaattaccatcgcaaagtttgaaccctcaacagctggttcacgttctgcaaattgtacgtgaagccaccaccaatgcgatcaagcattctcaaggcacggtaattgaaattagcgcaagaattaatgcggaaggcgagtatgaaattttagttgaagatgatggggttggcattccaaaccttgaagaacctgaagggcattacggcttgaatattatggcggaacgttgtcgtcagcttaatgcacaattgcatattcatcgccgtgaacaaggcggcacacaagtcaaaattaccttgccacatacattatattaggacatcaaaatgcaaaatttacaaccttttcacactttccacattcagtctaatgctcgtgaaattattgaagcacatagtatcgaacagctacaacaagtgtgggcgaattctaaatcagaaaatttacccactctttttttaggtcaaggaagtaatgttctatttctagatgattttaatggcatcgtgatccttaatcgtttaatggggattacgcacgaacaagatgcaaattttcactatcttcacgtcaatggcggggaaaattggcataaattggtggagtggtctattaataatggtatttatggcttagaaaatctggctctgattcccggttgtgcaggctctgcccccattcaaaatatcggtgcttatggcgttgaatttaaagatgtatgtgattatgtggaggtacttaatttaaatacgaacgaaacctttagactcgacacagaacaatgtgaatttggttatcgtgagagtatttttaaacatcgttatcagcaaggttatgtgattacagcggttggattaaagctaaaaaaagattggcagcctattctaaaatatggttcgcttgtagagttcgatccgaaaacggtcaccgctaaacaaatttttgatgaagtctgtcatatccgtcaaagcaaattacctgacccaaatgaagtgggtaatgcagggagtttctttaaaaatcccgttgtcagttcagaacattttgaagaaatcaaaaaacatcacgaaaatctaccgcactttccacaggcagatggctcagtgaaattagcggcaggctggctgattgatcaatgcaatcttaaaggttttcaaattggtggggctgcggttcataaaaaacaagcattagtattaattaacaaaaacggggcaacagggcaagacgtggtcaaactcgcccatcacgttcgccaaactgttgcagraaaatttggtgtatatttacaacctgaagtacgatttatcagtgcaactggcgaagtaaatagtgagcaaattatcacgtaattttataataattgaactttcaattgataaaatctgtcttattaacaaattggttcaataagatagcttattgtgctataactaggtacattgattggcaaaagccaaaataaagaagggaaacgatggataaagaaacacaaatgatgttagttcctcaaggcagtatcgaaggttatattcgtgcagcaaatgaatatccgatgctgaccgcagaggaagaaaaggaattggcagaacgtttgtattatcacgaggatttagatgcagcgaaaaaactcattttgtcgcatcttcgtttcgtgatccacgtggcgcgtggctattctggctatggtttgccacaagctgacttaatccaagagggcaatatcggtttaatgaaagcggtcaaacgttttaaccctgaagttggtgtacgcttggtgtcattcgctgtgcattggattaaagctgagatccacgaatatgttcttcgtaactggcgtatcgtaaaagtcgcaaccacgaaagctcaacgtaaattatttttcaacttacgtaaaactaaacaacgtttaggttggttcaatgaaaatgaagttgatatggtcgcaaatgaattgggtgtttccaaagaagatgtgatcgaaatggaatctcgaatgagcggtgcggatgtcggttttgatttacccactgatgatgcagaaacagagacctattctccagccctttatttggaagataaaagttctaatttcgcagcagagctggaaaatgaaaactttgaaagccaagcaaccgagcaattaggtgcggcgttacaaagtctagatgcacgtagtcaggatattatcaaagctcgttggttagatgataacaaagccacattgcacgacttggcagcaaaatataatgtctctgcggaacgtattcgtcaattagaaactaatgcactgaaaaaattaaaaagtgcggtgaatttttaaataatttagaaaaagaaaacctgctgattagcaggttttttatttctcatttaaccgtaatttcaaatcttcagcagtttggcaagtcttaatcttatcaaacacttggttcgcttcattatattccttattcaaataacgtaaccattgtttaattcgtgccacatgntaaaaaccgctgtcatattcattttcgacattcgcatatttttgcaagattttttgaatctcataccaaggcattttttctgcatttgatttcagaacatgacttaaattcggaatattcaacgcgcctcgtccgaccattaaatcctgacaacctgtttgggataagcaatcttgcccatcttgccaatgccaaatttctccgttagcaataactggaatggataaacgctctcggacttcgctaatttttttccaattaattcgatcagcacgataaccatcagcttttgtacgtccatgaactgtaatttcggttgcgccgccttgctctaccgcatcagcgatttcaaaggcttgagaaatatcatcccaacctaaccgcacttttacactaacgggaaattcacttggcacggctctgcgtaaggcttgagtggcacgataaatcaattcaggctgtttcaataatgccgcaccaccattgctgccattcactgttttagaagggcaaccacaatttaaatcaatgccatgagaaccaagatcgatcgcacgaattgcattttcagcaaggcattttggatgctgccctagcaactgsactcgcacaggcgtgccagaagaagtaaagccctgattttttaattcagggcataaacgataaaatactttttcagggagaagttgatcaactacgcgaacaaattctgttatacataaatcgtagtcattcacttcggtgagaagttcacgtacaaagggatctaaaaccccttgcataggcgcaagaataacacgcactatttccagccttttgctttacaaattaaatcgtaagcggcttgaatctgttgagttttttcttttgccatttccatcatttctggcggtaaacctttcgccacaagtttatctggatgatgttcattcattaaacgacgataagcacgcttaaccgtgctttgctcgtcggactcagtcacacccaatactttataggcatcatttaaagttgggcctgaagcatgttggtaaccaccactattttgttgttgatattggtagccaccttgataggcaccttgttgatatttctgataaaaaccgccttgagtaaaagctcgagcagccatttccatcgcaatcatttgttcaaattgcatacgagaaagaccaagttcttcagcgatcacataaagcacttctttctcattttcgtgaagttctgaatcggcaaaagctgcttgaacttgcacttgtaagaacattctcaataaatcagcacgttgcccacaaccaatgcgaaattcacggataacttgacgaatcgggaaatcagattctttaccacgacgaaacgcatcttgcgctaatttacgcccagcatcatccagtttaagstgaatcattaattgattagctaattggatatcttcttctgttacacgccctttcgatttgcttaaatgccctaacaccgcaaaggaggtttgcataaacaagtcttgacgcgttgttttctttttaaagaaactagnacttaccgagccaagntcatacaattttttatctgcaatagagcctaaaatgagaccagcaatcgcaccaaaaaatccaccaactttccaacctaaaaatacgcctataatttttccaataaattccattctttcctctgttaagtcaaagtgcggttatttttataatgttatttataatgatgataaaaatttatttctcaagttttatacgccaaattcggcacgataagcacgcatttctggcaaatggctactgtatcgaggatcttgttcgataaattgcatcaaatcatctaaatcaatgattgatagcacttggcattgataatcacgttctacttcttgaattgctgaaagctcgccttttcctcgttccttacggtttagagcgatcaataccgccgcaagttctgcctgatttgcactgattaattccatagattcacgaattgcagtgccagccgtaatcacgtcatccacaagcaaaatttttccttgcaatgggctaccaattaaattgccgccttctccgtgatctttcacttctttgcgattaaaacacacgggtttatcaataccataacgattaaataacgccaccgaaactgacgtgccaattggaatacctttgtaagcagggccaaaaaccacatcaaaatctaccgcacttgcttgaattgccgcagcataaaactcgcctaaacgcgctaaatctgcccccgtattgaacaaacctgcattgaagaaatacggacttttacgccccgatttcaaagtaaactcgccgaatttcaatacatttcggcttaaagcaaattcgataaaatcgcgtttatattgttccattttttaactcctataaactgtgtttataagcctaacgcttcgcgttgagcgataaaaatttgattacagccttgtttcgctaaatctaataatgttaataattcttcatggctaaatggctcgccttctgcagtgccttgcacctcaatcatgcgaccatcttccatcatcacaacattcatatcggtttccgctgcagaatcttccacatattccaaatcacaaacagcttgaccatcaacaatccctacagaaattgccgaaactagccctttaatggggttagtttttaacgtgccattctcaattaaaccattgatcgcatcacataatgcgactgcagcaccagtaatggatgcagttcgtgtgccgccgtccgcttgaataacatcacaatctaaagtaatcgcacgttcacccagtgctttaagatccaccatggcgcgcaaagagcgggcaattaagcgttgaatttccattgtgcgtccgccttgtttacctttagccgcctcacgttgcatacgactatgtgttgaacgtggcaacattccatattcagccgttacccaaccttgcccttgtccttttaagaaacgtggcacagcatcttccactgttgcagtacaaagcactttggtgtccccaaattcaacaagcacagaaccttcagcatgcttggtgtagttacgggtaattttaatttggcggggttgattattttctcgattatttggacgcataattattccttgatatggtttcgaacgatgtaataaaaaagcgcactattctagcacgctttagtttttatttttgttaaaattcgctaagatattgattattgataataaaacagcaaggtgctttaccttgctttattaatttggtggagataatcgggatcgaaccgacgacctcttgaatgccattcaagcgctctcccaactgagctatatccccataaaagacagcgacatgataaaatttgactatgtggctgtcaatacgattttattatgtgtttgttatccgattaaatattaagcgttttgtgcatgaataaaatcaatagcacgctgaatacgcgcaagtacgcgatctctgccgataccgactagggtaacatccattgatggcgattgaccagaacctgtcaccgcgacacgtaatggcatgccaactttacccatgcccacttctagttcagcagctgtttgctcaatggcttcgtgaatagaatgtaaatcccagctagaaagtgcggttaatttttctttcacttttgcaagcgcttcagcagcattgcctttgaaatgttttttcgctgcggcttcatcaaaggtttcaaactcttcaaagaagtagcggcttgaccttgccatttcttttaaggttttgcaacgttccgcaagcatggtgactatttcagttaatgcagggccattgcttgtatcaatgccttgatctttgtaatgccattcaaggtgtttagccacatattctggcggtaattcacggatataatgttgattcaaccattgtaatttttcggtattaaatgcgctagctgatttgctaacatgatctaattcgaaatagttgatcatttcttcgcgactaaaaatttcttggtcgccatgtccccagcctaaacgaacaagatagttaattaaagcttctggtaagtaaccatcatcacgatattgcattacgcttactgcgccatgtcgtttagagagtttttgaccatcatcgccattaatcatagaaacgtgtgcataggttggaattggggcaccaatcgcttttaaaatgttaatttgacgaggcgtgttgttgatatgatcttccccacgcacaacatgtgtgatacccatgtcccagtcatctacaactacacagaagttataagttggagaaccgtctgtgcggcgaataataagatcatcaagctcactgttgctgatttcaatacggccacgtacggcatcatcaaataccaccgagccttcagttggatttttaaaacgtacaacgtggggttcatcaggtgaatggttgtgatcgtgtaagcagtgacggtcataacgtggtttttctttattttgttcttgagtatgacgaagttcttctaagtgttctttagtacaataacaacgatatgctaggccttgttcaatcatttcatcgatcacttggttataacgatcaaagcgtttagtttggtaataagggccatgctcccacggaagatttaaccattccatgccttcaataatggcagcagtggcttcaggtgttgaacgctctaaatcagtgtcttcaattcgtaatacaaattcgccgttattatgttttgcgtataaccaagaataaagtgcggtacgtgcgccacctacatgtaaataacctgtagggctaggagcaaaacgagtacgcacttttacatttggatctaaattaaaaggagcatctagtttcatttttataacctatcttcaataaaatattagtcgttattctactacgacttgtttgacttctaaataaaaaagcggattttatgcttatttttacgacaattaaacaaaatttaataaaaaggtattgactgaaaatgcattctccctataatgccaacccacaacattaagggcgattagctcagttgggagagcacctcccttacaaggagggggtcactggttcgagaccggtatcgcccaccacttctctaaaaagttttcttaattttactaagtttgaccaagcgggcgattagctcagttgggagagcacctcccttacaaggagggggtcactggttcgagaccggtatcgcccaccacttttctaaagtgtcctttccgctcaaactttccctttatatttaaacgctttctagtgggcgattagctcagttgggagagcacctcccttacaaggagggggtcactggttcgagaccggtatcgcccaccacttaaaagtgtttaaataaaccgaaaatttagggttttgccttaatattatcgggcgattagctcagttgggagagcacctcccttacaaggagggggtcactggttcgagaccggtatcgcccaccactttattttcaaattatccaaataatttccttttcccgttcaatctattacgtttacgtgataaagtgcgcaggcattgtcatatctaattttaaactgtttatatatcatagggaaaatttatgatcgcttatattttcttagctttattcacgattgcggcagtgatttttatcgtaaactcccattatcgttggacttatttctttgctattacgctttttacttttttatttggtggcatgcttatggtttccagccaatggcaacgtgctttaaatttttcatctgtgctttttgtggtactgatgttatttcaccgtttaaaaattcattattacaaacaacctttgttaatttcagatttctttcttgtggtagattggcgaaattgggaaaccttaattcattataaaggtgcattgtttggcgttattgggctactggcgttattaggttatgcgattttkggttttaatgatgtcgagtctttaggggtattgggtaacagcattggtgctttattgtttatcgttagctttagcttgatgtggcattattctaaaaatccaagtgcggtgcaagtttggttagattctttgcctgatgatggtcgtgatgtgtttttaaatttaccaatgtcttgtcgcggtatttttttcaaagtgccaaattttgatggcaatagccaaaattttattgaaaaaatgaccgcactttcatctgatgcaaacaacctatctgaaacaaaacccgatattgttgtaacattaatggaatccacgctgaaccctcatcaatttgcttttagtcagcaatctattccaccactttccatgtttgaaccccaaaatgatacagtatttgcttcgccgttgcgtgtacatacttttgctggcgcaacatggaaatcagaatttgcttttttagccggtgtgccttcaaccgattttggggcgttagcaagtggagttttttattctgttgtaccgcacttgcaatcaggtttagtgaaaaatctaaaagctcaaggatatttttgtgttgccttgtcgccttttacaaaaggtaattacaatgcaaaatccgcttatgatcatttcgggtttgatttgatgttacagccgcaagatcttggttatcctgcacctatcagtaaaaatctttgggatattagtagtgaagaaatgatgaaatacacccgaatgattttggaaaaacagcatccagcgttagaaaatgtagatcagccaatgtttgtttatgtattgactatgcgtgaacatggtccatacgaattaggcatggaaaatacatttaatcntcaaatgcctnatttaggagcnaaaagtanntctgcattgaatgactatactcaacgtattgttgcattgaatgatgcgattgaaggaataaataactatttacatgaacgtaaaaagccttttgttctaggttatttcggtgatcaccaagtggcatttgataatgcgatccctccgaagaaaggggattatgcacagcctgattatgtgacacaatttgttgtaagaagtaattgtgcaagtcaatttaagcaagaacaaaagtttttagatcttgcttttgctggaggtgttttgatgaatgtagctggattatcagcagaagatgaatttatgaaagcgaatatggcaatgtgtaaattgagtgatggcaaattagaagattcttctgatattcagctactcaataattatcgccattatttataccaaacattggcgattgccagataattttcttatngatcgagcattattgctcgatcngctcgccaatttcatccaaggttgaagctaattgcgcaccaactagcaccacaagccaacttatttgaatccacaataacataattggtaaagttgccattgcaccgtaaattaattgataagagggaaaagtgacgatataccaagtaaatgcttgtttaccaagagtgaaaaaaatcgcggcaagaaatgcaccgtaagctgaatgcttaattttcacttttttattcggtacaaccgtataaataagcgtaaaaataaaccaagtaaataaaaaaggcacaaaactgagcaattttaagcctaatgataaatgttccgattgctcaaacattattttaatatacgaactaatcccaatgctcacgccaataataagtgggccaagtgtcaaaatcatccaataaatcgcaaaagaagaaagcggagagcgagattgactattgtgccaaatactatttagtgttcggtcgatgttattaattagcatcaaggcaacggcaattaaactcacaattcccaccgcactcattttctttgagtttgatacaaattgatcgatatattcgcccaccatatcactcgctgatggcgcaaaattagtnaaaatcatttcttttaattctcccgttacttcattgaatacaggaaaagcagagaaaatagaaaaaataaccataactaaaggaaccattgctaacattgtgctataagtcaatgcgccagctacttgattaagtttattttctgaaaaacgtttccaaaataataatccaaaattttttaatgaaatcatagaaatcctccacaacaatgtttaaattttttacccgaaccacagacacaaggttgtttcattgtcggtaatgatacggtcggatccacaaaataccaacgatcttcaattttcacaaaaattgaccgttcttgatgggcttgctcacattcttcgccttgaaaaatcgccttaaattccaccgcactttgagtttttgtaaggctttccgtttttagaatttctaatcctagccacgtagtgttgtcagcccattcttgcaataacctaggctttaataaagtttgttggcttggcacagttgttacaacaatatagggaatattttttaacacataagccgtataacgtgaacgcataagttgctctgccgtttcgggaaatgcttgtctcaaatgaaatttgccacaacaatctgcgtaatgatggctagattgacatggacaattttctaaagaaagcgcggttgaaatttctgacatatttatccctgttgtttgaatttcgatatttgcgatcgaattgagcgtttaaaggcttcagctaatacttcaatctctaatgctgaatctaattcagcttcattttttggcgtagataacaagcgatttaaatgacgaattgttatttgcggataaggacgggcgagtaattttaattcatccttttgcttaattgttcctgtttcaataatacgaacataccatccactgagcccagtttgataaacaatatcgcgagtctcttcgttttccgtgttttttgataaacgctcacaaggtttacgtggttgagatacttctaaaatggttgagccgatttgataacgatcgccaatacatacattgtcttcattcaagcctgacacgacaaaattttctccgtatgtcgcagtatccatataaggaaaaatctttatttaataaagcatttaattcattaaaagaatctgccgacataaaaaagagagctttatctacaccaccgtgatgtttttttaaaccaacatcgtttccttccgcaccaagagaatgaatttttaccgatggcacaacttttttacgaatcgcgctttcatactggcttccatcggaaaaggttagggtttcaacttgccccacttttatgactaaaatttttgcattcattttatttttcgcttgttctagaaaaaatttacgtggaattataaccgaaaacgtttaactttttgaccgcacttctttttttacttattattcgttatcagaaaaacaaaaaagaaataatgaaaatgtttgaaagagaaaaaaattttctaaaaatattttatttcttttcttgaaaataagatttttcctaagggcgaaatcatcacgttcaatgataataaggagatttattatgtcaggcgtattccacctaaacctcactaaagcacaacttaaaggtgcaacactcgctattgttcctggcgatcctgcgcgtagtgagcgtattgcgaaacaacttgataatccagagtttcttacaagcacgcgtgaatttacatcgtggttaggttatatcaatggtcagcctattgttgtatgttctacgggtattggtggcccttcaacatcaatttgtgtggaagaacttgctcaacttggtgttcgcactttcttacgtattggcacaacgggtgcaattcaaccgcacattaatgtaggcgatgttcttatcacaactgctgctgtccgcttagatggtgcaagccatcattttgtaccattagaatatccagctgtggcaaactttgaatgtacaaccgcactttataatgccgcgaaagcaaaaggtattgagccttatgtaggtgtaaccgtatcatctgatacattctatccaggtcaagaacgttacgatacttatagtggtaaagtatatcgtaattaccaaggtttgcttaaacaatggcaagatttgaatgtcatgaattacgaaatggaatcttcaacattgtttactatgtgtagcgcattaggtttgcgtgcaggaatggttgcaggcgtgattgtaaaccgcactcaacaagaaattccaaatgaagcaacgataaaacaaacagaagaaaaagctgtgtctgttgtgatcacagctgcacaagcattgttaagttaaattaatatttatttgaaacaataaaactttattttattctgcaccttaattagatttattttctaacgaagtaaggtgcagattttttattaataaactgcgatcttctgatcaatttaatcaaagtagtctatttacttgttggcattgaaacctaaacttgatataagttctaaataaactacttctaaaggctaaataacctaaaatatttacgactaaaattagatttctgttaaatctacatttttagtctcttttgaggctaataatgccaagaaagtcattaatgcattgattgctaaataaattcctacacccattacaccgaatgacgcgttaatttttaaagaaatcattgctgcaattgttgcaccaataattgatgctaaattatacgcaagagaggcacctgaataacggacttctgttgggaataattctggtaatagcgcagccattggaccaaatgtcattcccataatcgccataccaatcactaaaaatgcaaatacgctaactggagtgccattttctaagaataacggcattgctaaaccaagcacgccgatagcaatagtcacccaaatcaaccatttacgacgaccgattttatcggcataaaaaccggaaatactgataaaaataccaaatacaatggcactaattaataacaagccagtaaatgtatttgctgggattcctaaaccaagtgcataacctgcttcagaaagctttggtgctgttcgagaatatgcctgcgcaaaagccgtcataatgtaaaacagagaataagttgccaccataataaatgtgccaataaccattggttttaagtgtttggtaaacacaacactcactggtgcattcaattttttgcctttttgctctgcttccacaaatacgtggctttcgtgcaaagttaagcgaacatataaaccaactgcaactaataaaatggaagatacaaatggaatacgccacgcccattcaacaagtgcattatgaccaagcaaatagctaactaagaagaacgttccattagcgacaaataaaccaattggtgcgcctaattgagggaaagtaccgtaccaagctcgttttccttctggtgcattttctgttgcgactaacgctgcaccgccccattcgcccccaagcccaataccttgaccaacacggcatacgcaaagcaaaatcggcgcccagataccaatttgagcataattaggaagtaaaccaattactaccgttgaaccacccattaaaacaagagaggcaaccaaggtttttttacgaccaattttatcgccaaagtgaccgaataatgccgaaccaataggacgtgcaaagaatgctaaagcaagcgtagaaagagaaagtaaatcattagaaagcggatcatcgctatgaaagaattgcgtattgaaaactaatacagcggcagccgcatagatataataatcaaaaaattcgattgctgtaccgaccatcgaggctaacgccactttcatcggattattacgaagttgtgtagacattgtgtttccttagaagtttattataaagagaaaggattgaatcctagcattttaactaaggtctaacaatttttaatatgcaattttctatttttttagagaaatattttgaattttctaaatgtgagttatgtccagcgcagggaattgtcactaaatcaatttgattttctttggctaatacttggaacttatgatctctttcgccacaaaaataaaaaaatggcaaagaacttaaccgcactttttcactaaaatcaggttgtttggatagacttgtcgccagcaacattttgccaatatttttcccacaatttgattttcgtttttcaaccaactgtaatctttcttctgtagtcaaatgagaaaacacaggttgttgataccaatcattcaacactttttctggcgattcttgcataaaacgttgcgcccaagcaaaatcctgctgaaaacgagcctgcttttcttcgtcagtttttaaacctagattcgcaccttctaaaataacgccttgcaaattagatcgttccagctgagcttgcagcgcataatacaaagcaatcctgccacctagagaatacccaacaagaaaatagggtccatttttcaccgcacttttaatttgctgagccaaatactccgccgaatcttcaaaatttgtgacttcaaggtctttagcttgcccgtgaaaaggcaaatctagcgcaatacaattaaagtgcggtagattttcaatgactttttgccagtcattttttgtaccaagaagtccgtgaagaaaaatgatgtttatcattgaagggattattgatagaaataataaaatatggcggactaaagcccgcctacagaatacttaagcaccaatcacggcgtgactaatttgctcgattaagcgtttatacaaactgctaccatcactcggattcgttttaatttcaattaacgttgccttgcgacgactataagcctgtttcacaacagaattgagatctgcccaagtataaggatgagcgtatttaagatcgaacattgccgcgatttgagaaaaatcgccattatgcggtaatcgatagaactgatctttgacttgttcatccacaggtaacatatcaaaaatcgcgccaccattattattgatcacaaagattagcgttggttgcgtaacgtttttgaataatgcgaaagaattcaaatcatataaagtggacgtatcgccaatcaccgcaacaacaggtttatttgaaccaatacctattccagcagcagtagccaacaaaccatcaattccactcgcaccacgattggtataaacgggataactttctggtaattgcgttagcgcatcaactagacgaacaagtaaactattacctaaaaataaaacaccgttataaggtaaaagtgttggtaaacgtaatgcgagcgaggcttccgttaaatttccgcctacttgctgttcaataaaggtcgcacagaacttagataaagctaacggctcaagcaaccaaggcttttggcgtaaaggtggatgtgcacgcaaccaatgatgtactttagcattaaatcttgtcaatgaatgatggtaaggatctaatgctttaccgctttgttcaactagccaaaattcccctttaaacgcttgcaagaattgattaatgcgtttactaataaaacgcgcgccaaattgaatcacaatatcagcttgtagaagtttttcacgaacagtttggtttgccagccaaatatcttcataaggcgtcgttggaacaacaccagattgaatatccgtcagtaacacccagcccatagcacttgcccaagaattaatgcccatcgcttgttctgcaggtaattgaccaaccacaacgacaccacgtttggtacgccaatgatcccaattttcatgcattaatacttcgttttgttgcgcttctacatttatccaagacttgttttgaattaaccagcgttgtaacggctgtagccaactatgggaatttacttcctcatcagttgcatcataaagtggctcggcaaatgggacattaatatgaacaacgccaccttgttgtttttgttggaaaactgcctgttcaagtagagaaattaaccactgcgcagaataatcagcattcggtttaggtaaattaacatttgcaactggatactgaccaaacatattttgttgcaaaatggcctgatttgcaccgcactcccaaagttctggtggacgatcagcagttaaaacaaataaatttacaccagtttggcgtgcttcaataatggcaggataaaggtttgctgttgcagtacctgatgtaacaataattgcaacaggcgattgagttgccttagcaatacccaaagcaaaaaaacctaaaccgcgttcatcaaaatgcgtatgacaagtgactgcgcccgcattttgcaaacgtacggcttctagagttaaaggtgtcgaacgcgaacctggcgcgatacaaaggtgagaaacgccttggcgcaccaaggtttctaaaatcactttcgaccaacaacgattaaacacgcttaccgacattttttttctccgttatcatttttcttctgcaaacaaggaaattaaccctgctgctttacgttcaatttctttccattcttccaatggctgcgagcctgccacaatgcccgcgccagcaaatactcgaatacgatgaccttcaataaaagcagaacgaatcgccacacaaaactctgaacatacatcgctcatcacgcccaatgttcccgcataccagcctcgatcaaaggtttcgatttctgacaaaatcattttggcttgttgctgtggcaaaccagatactgcagctgtaggatgaatcgcttttaatatatttacatctgcataatgtgcggtcaaatttgcacgaattttacgaatcaaatgttgtactttacgtaacggtttcaattccacattgcttacatcaaaactttctacttgcttacgtaaattctgcgaaatatcttctacaaccaaccaattttcttttaaatttttctcatcatttaacaaccaattggcttgagattgcgtttcttcctcactttcagaaaccgatgctgtccccgccaaagcttcggttagcaacaaattatactcacgagcaaataggcgttctggcgtagaaccaacaaaaaccgaatgagaattttcagcccataaaaaatgataacaaccttgattttgtttttcgctttctgctaaaaaatcgtacgcattaatcgcttgctttaaatgaaaagtggtttcattggctaacacaatttttgtcagctctccacttttaatttctaccaaagcctgatttacccaatcacaccaagttctttcattggctcgaagctctgtatgcaaaggaatttgttttggcaaagcagaaagtgcggtgagattttcaaaagttttgaggtgggctaaagtatcattcgcactttgctcatttttcacaaaaaaggataccaacgtgcctttattatcctgttcaacaagcattttaggtaatacaaattgtgcagtgccttgaaattgcaaaccgccgaccagtggaaaaccactttcttcaataaactcttgcgctaaatttaactgtgaaaatgactgcactgccccaagcgcagccaatgctttttcttcatcacgaaaatgtaaataaaattgaggatacgcagattgacctttcagccacgccaacaaatcgaccttgtccagttttacctgaaaacggacaagttcattcgttgattgctgtaaatatgcgtgaatttgcgattttaactcgcctattgcctgcgctaaataactcattagattttgttttaaatacacaaaaaattagccatattctaccgcagattgttaatgacaaaaaatttttttacaaaatcttttcaatattgaaaattcagcgtaaattaaccgcacttttctcgaaaaatttattagaaacaaaaggatttcactatgcgattattcccaaaatccgacaaattagaacacgtatgttatgacattcgcggacctgtgcataaagaagcactacgcttagaagaagaaggcaataaaattttaaaacttaatatcggcaatcccgcacctttcggctttgaagcaccagatgaaattttggtggacgtattgcgtaatttgccgtcagctcaaggctactgcgattcaaaaggattatattctgctcgtaaagccattgttcaatattaccaatcaaaagggattctcggcgcgaccgtcaatgatgtgtatattggtaacggcgtatctgagcttatcacaatggcaatgcaagcattgctcaatgatggcgatgaagtgcttgtgccgatgcctgattatccgctttggactgctgcggtaaccctttctggcggtaaagcagtgcattatctctgtgatgaagacgcaaattggtttcccactattgatgatattaaagcaaaggtgaatgcgaaaactaaagcgattgtcatcatcaacccgaacaacccaacgggtgctgtgtatagcaaagaattattacaagaaattgtggaaatcgcgcgtcaaaataatttaattatcttcgctgacgaaatctacgacaaaattttatatgatggcgcggtgcatcatcacattgccgcacttgctcctgatttattaaccgttacattgaatgggttatcaaaagcttatcgagttgcagcttccgccaaggctggatgattttgaacggcccaaaacataatgcgaaaggttatattgaaggcttggatatgctggcatcaatgcgtttatgtgccaacgtaccaatgcaacatgcaattcaaaccgcacttggtggctatcaaagtattaatgaatttattttaccaggcggtcgattacttgagcaacgaaacaaagcctatgatctcatcactcaaattccaggcattacttgcgtgaaaccaatgggggcgatgtatatgttcccgaaaattgatgtgaaaaaattcaatattcacagtgatgaaaaaatggtgctggatttactccgccaagaaaaagtactacttgtgcacggtaaaggatttaattggcattcaccagatcacttccgtattgttactcttccttatgtgaatcagcttgaagaagccattacaaaattagcaagatttttgtcggattaccgtcaataatgaatgctttgacaacattacaaaggggactaaatgtcccctttttatcgatataaatatattgcactttccttgtgtactactataatagtgcaaatttattttagaggcattttatgatacaacaaaaatctccttctctcttaggcggtgcaatgatcattgcaggtacagcgattggtgcaggcatgctggctaacccaacttcaacggcaggtgtatggtttatcggttcaattcttgctttaatttatacttggttttgtatgacaacctcaggattaatgatcctagaagctaatctacattatccaacaggttcaagttttgacactatcgttaaagatttattaggaaaaagttggaatactatcaatggtctttctgttgctttcgtcttgtatattttgacttatgcctacataacctcaggcggaggcattacacagaatctgctcaaccaagcattcagttctgctgaaagtgcggtagatattgggcgaacttcaggatctttaattttctgccttattcttgcagcctttgtatggctttcaaccaaagcagtggatcgtttcacaaccgtgttaattgtcgggatggtggttgcttttttcctttctactactggtttattaagctctgtaaaaacagcagttttattcaataccgttgctgaaagtgagcaaacatatttaccttatttattgaccgcacttccagtttgtctcgtgtcgtttggtttccacggaaatgtcccgagtctcgtcaaatattacgatcgtgatggtcgtcgcgtgatgaaatcgatctttattggtacaggcttagcattagtgatttacatcttatggcagctcgctgtacaaggtaatttaccacgcactgaatttgcgccagtcattgaaaaaggcggcgatgtttctgcattattagaggctttacataaatatattgaagtggaatacctttccgtcgcattaaatttctttgcttatatggcaatttctacttcattcttaggcgtcactttagggttatttgactatattgcggatctatttaaatttgacgatagcttattaggcagaacaaaaacaacacttgttacttttttaccgccattattgctaagcctgcaatttccttatggatttgtgattgccattggttacgctggattggcggcaacaatttgggctgcaattgtccccgcacttcttgccaaagcaagccgtcaaaaattcccacaagcaagttataaagtatacggcggaaattttatgattggttttgtaattttatttggcatattaaatattgtggcgcaaattggggcaaacttaggttggtttgcaagttttactgggtaagttttaaaaaataaatttaaattattaaatagcgatctgcactttaacagtgggttatgtagtccaactaattcgtgtagatcagccccttaattattttactttttattagttacaaacaatcttaactgcaagtccgccttgagatgtttcgcgatacttggcgttcatatctttacctgtttcgtacattgtttcaatcactttatctaaagttactcttggattagtggtacggcgtaaagccatacgcgatgcattgattgctttaactgaagcaatcgcattgcgttcgatacaaggtacttgaacttgaccgccgacagggtcgcaagttaatcctaaattatgctccattgcaatttcagctgcgatgcatacttgtagtggattaccacccaaaatttcagctagtcctgcagccgccatggaacaggctacacccacttcaccttggcaacccacttctgcaccagaaatagaagcgttcatcttataaagtgaaccaatcatccctgcggctaataaatagcgttcaatgatttcaggtgttaatggcgagatgaatttttcatagtaagctaataccgctggaataatcccgcacgcaccattagttggtgccgtaaccacgcgtccacctgctgcattttcttcattgacagcaagcgcaaacatattgacccagtcgattacgcgcattggatcgttagataaattcgtatttgcttgcaacgcacgataaagtgaagctgcacgacgtggtactcttaatgggccgggtaaaataccctctgtgtgaatgccgtgttcaatacaagcctgcatcgttttccagacattctctagatgagcactaacagcctctttgccattcaatgcgatttcattttccaacatcacagtggaaagcattaagcgttatcactacaatgtttcaaaatatcttcggcatttttgtaaggataaggcacttggactgtgtttttttcttctttgccaaaatgggcttcatcgacaataaaaccacccccaatcgaataataggtttggcgataaagctctgtgcgattttcatcaagagcggtaattgtcatgccattttcgtgcaattttaaaaaagtgcggtggaaaatgagattattttcaaaatcaaattttactatcttttgaccgacattaatgggtaaaagcgcagtttgtttaactttctcaatgaaacctgaaatcatatcaatatccacattatgtggtaaataacccgctaaccccataataatggcaatatctgtactgtgtcctcgtcctgtcattgaaagagaaccgtacacatctacgtgaatttcagtagtttgttcaaattgatttcgtttaattaagtcgtctataaattgtttacccgctttcatcggaccgaccgtgtgggaactggatggcccaattcccactttaaacatatcaaatacgctaatcataaatttctcaaaattcgttaaaaattaaaggcgattataataatccataaacaactgcagaaatagcaattagccccataattgttacaaatacattactgaaacgtccgctgtagcgtttcattgctgggatttttcgaatcgcgtacattggcatgataaacaaaatcatcgcaatgattgggccgccaagagattcgattaagcctaagatacttggattaataatcgcaacgccccataacgttaataagaagaaaagtgcggtcgcataattgagttttttacgatttactgcttcacctttcatttttaaatataaaccttctaagccttcacgtgcccccatatagtgaccgaagaatgaactagtaatcgctaagaatgcaacaagcgggccaaaataagagatatatggattatcaaatttattcgctaagaaagacaagatactaatattctgttcttttgctgccactaattcttcaggtgttaatgttaatacacagctaaatacgaagaacattacgaagaataacaaaatcgttgaggcgcctttttctgtatggctgatatggcgttctgcaccatcgaaagttttatattcacggaattgtgagcaagtgaaagatgaaattgctggcgaatggttaaatgaaaatactaatacgggaatggttagccataaagttgttaagaaaccgcctactgttggaaattcatataatacggcactattccattcaggaattaagtaaatagaaagracaaataaaattaagactaacggataaacaagccattctgtgatttttaacatcactttttcattaaataacatcacggaaatcaataccgcaattaatacaaaagagagaatgactcgatttggtgatgccataccaagttgattcacaataaaagaatctacggtgttcgtgataccgttaccgtaaatcaacagaatagggaaaatcgcgaaaaaataaagtaaggtaataagtttacccgctgttttaccaaagtgttcttccactacttcagtaatatcgctgccaggattttttgatgaaagtacaaagtaggctaagccacggtgagcaaaataagtcattggcccgacgataattgccattaaaactaacggccaaaatccacccatccctgcgttaatcggcaagaacaatacgcccgcgccaaccgccgtaccgaaaaggtttaacatccacgttgcatcaaatttgttccatttgagtttttctgttgatttcatagtttgctccaaagcataaattacttaaatttgtcaatttgtagagcaaaatccgctccaactaaatttgagtattatgttatgccaataaatagagaatctcaaagagcaaattctaaaattgtgatcaagttaaaatttttttataaaaagtgcggtaattttcagcgacaaaaaaatcggtgcgatgacgacaccgattgcgtataaaaataaatgaaattagaaccgcacttttttcaatcttaaggcgttcatcaatacggaaattgagctcaacgccatagcagcaccagcgattatagggctaagaaaaccgaaagcggcaaggggtatgccgagaatattgtaaatcaaagcaaaaaatagattttgtttgatatttttcaaggttgctcttgcaataaaaagcgcatccacaagttgattcaccgaatgttgcataagcgttgcagaggctgtttgttctgcaatatctgaacttgatttcatcgcaaaactgacgtttgcagaagctaaagcaggcgcatcatttattccatcgcctaccattgcgacaatatgacctagatctttcagcttttggatttgttccgctttatctcttggagttagtttcccaaaggctttcttaatgccgagttgtttcgctatgtaatccacgacagattgttgatcgccactcataattacgacatcaatattttgctgttgtaagcgttgaatggcgtgcaagctatcgttttttaaagtatccgtcagtgcaaatgcaccgatgggttcatcatttatggatactgcgacaatgctcgcaatttgccaaatatcctctaaatttttaggcaagattaaaccgcaataatcaggtttaccgacttttattgttcccacttgttctaattcggcttgaatgccttgacccacttccatctttgaaaaaagtgcggtgggaatttctaacatttttngttctgctgcttgcacaatagcttttgcaattgggtggttagcttgtcgttcaactgctgctgcaaaacgatacaaatcgtcttcagaatacaccgcactttgtggctgccataaagcagagatttcaagctctccttttgttaatgtgccagttttatcaagtacaacggtatccacgtgggcggtttcctccattgcagccgcatctttaaaccatacgccagcattgactgctttacctaaaccaaccattatggctgctggtgtggctaatcccaaggcacaagggcaagcaatcacaagcacggataccgcgtgaattagtgaagacacactatcattcgtcagaatataagtgagtgcgaaagtaacaagtgaaatcactaaaacgacaggcacaaacacggaagtaactttgtcagcaaatcgagcaatgggtgcttttgaaccttgtgcatctgataatgcattcatcatatcgccaagtaaggtttggctaccaagctgatttgctcgatagataatagaaccttctgttaccatcgcccccgctaatacttttccacctttctgtttttcttctgggcgagattcccccgttaaatggctttcatcacaccaaccatttccactttcaattacgccatctgccgcaatacgctcgccttgattcgcacgaatgatttcgccgatattgacttggtcaagagcaatttcaatccatttttcattacgtaaaacagtgacttttttcggtgtcagttgcaagagcatacttaagctatttaggctgtgctttttagtgcgatcttcaagaaattttccaagactgacaaaaccaattaccataacagaagcttcaaagtacacatgtcccattgcatgattggcgtggtaaaacaacatgaaagcagaataaagataaatagtgagcgttcctgtgctgaccagtacatccatattggtaagtccaccacgaatactaccgattgctccgcgataaaatggaatggctaaccaaagttgcacaatgctcgctaatgcaaattgccaaatcggcggtaacattaagttatgggagccacctatcataccaagcattccaatcagaaatggaatattgattatccaaagtacgattaatcgccaagggattgatgtattttcttctattggtaattcgttggcttgtttgatatgggcagagaaacctgttttatggataatctctataatttgassttcgcttgcttgcgtagcgtcaaatacaacttgtgcttcttcggcagcaaaatttacgcctgcttgttgcacaaatggttttttatttaaaactttttcaatgcgattggcacaagattggcaggtcatcccaccaatctgaattgaaatttttttactctgtggcgtcaaatccagcatcttcaatgacctcaatcaactgtgcaacattgactcgattttcatcaaaagtaatatttgctttaccctctaattgcacatcagcagattgtacaccatctaattcagttaaaacttgagtaagattttttacgcaacagccgcaatgtatgccttttatgtttaatgtgatagttttcatttttactccttgttagttgttttattgatgaatgcgattggcaggccatcccaccaatctgaattgaaatttttttactctgtggcgtcaaatccagcatcttcaatgacctcaatcagctgtgcaacattgactcgattttcatcaaaagtaatatttgctttaccctctaattgcacatcagcagattgtacaccatctaattcagttaaaacttgagtaagactttttacgcaacagccgcaatgtatgccttttatgtttaatgtgatagttttcatttttactccttgttagttgttttattgatggttaaactataaacctttacataaggttaaggtcaagaagttttttatgaatattagtgaagccgcaaaattagtaggtttatctacaaaacaaatccgtgattatgaaaaaatggggttaattaaacccgctgttcgcagtttgtcaggctatcgaaattatggagaaagtgatttagaaaggttgcattttattcgacactcacgcaatgttgggttttcgttacatcaaatcgcacaattattagcactacaagataatcctaagcgtagctgccgagaagtgaaagtgctaactgctcaacatattgcgacattaaatcaacaaatagaacagttacaaaaaatggtacaaaaattgcagcactggcacgacagttgtcagggcaatgacaaccctgaatgtttaattttgaatggcttgaacggataagtgaaaagtgcggttaatattcccagctttctggatcgacacctaattcacgcataagcactttggcatcttcagggatttcatcattacgctctttcattaaatctgcatcggtgggtaaaggttgtcctgtgaatgcatgcaagaacgcttcacaaagcaattcactgttagttgcgtgacgtaaactttttaattggcggcgagtgcgttcattcgtcaaaatttccagtactttaatgggaatggatactgtaattttttttacttgctcactttttttgccatgttctgcataagggctgatatattttccgtcccaattcgccataatttcccttaagtgcttattgataaccttacaaattgtccgtattctaattaaaaatcaaataaataacaatctagacggctaaacttccaaaataagttcttaaaaaaagtgcgatgatttttatattaaatgctaataaaagctagacagcgtagggttttagtggtaatttacgtgccattcaaagggtgcaagcccaccattcgaataatcaattcttattaattccaacatttattcattatgcatttaacagaacttaaaaatacgcctgtttctgatcttgtgaaactcggcgaggagcaaatgggcttagaaaatttagctcgtttgcgtaaacaagatattgtctttgcaatcttaaaacagcacgccaaaagtggcgaagatattttcggcggtggtgtgttagaaattttaccagatggttttggtttccttcgttctgccgacagttcctatcttgcaggccctgatgatatttatgtttccccaagtcaaattcgtcgttttaatcttcaaactggggataaaatcgaaggtaaaattcgtccaccaaaagaaggcgaacgctattttgcacttttaaaagttgatcaagttaatgatgacaaacctgaagtttcccgtagcaaaatcttatttgaaaacttaacaccattgcacgctaattcgcgtttaagaatggaacgtggcaatggctcaacagaagatttgactgcccgtattttggatttagcatccccaattggtaaaggccaacgtggtttgattgttgctccgccaaaagcaggtaaaaccatgttgctgcaaaatattgcgcaaagtatcacacataattatcctgatgtagagcttatcgtgttattgattgatgaacgcccagaagaagtgacagaaatgcaacgttccgtaaaaggcgaagtcattgcgtctacttttgatgaacccgcaactcgtcacgttcaagtggctgaaatggtaatcgaaaaagcgaaacgttctgtagaacataaaaaagatgtggtcattttgcttgattctattactcgtttagcgcgcgcttacaatacagtcactccagcttcaggtaaaattttgtctggtggtgtggatgctaatgcgttgcatcgtccaaaacgtttctttggtgctgcgcgtaacgtggaagaaggcggcagtttaacgattattgcaacagcactagttgatacgggttcgaaaatggatgaagttattttcgaagaatttaaaggtacgggtaatatggaattacacctttctcgtaaaattgcagaaagacgcgtattcccagccattgactttaaacgctctggtactcgtaaagaagacttactcacaacagcggacgaattacaaaaaatgtggattcttcgtaagattcttaatccaatggatgaagtggatgcaatggaattcttgattgataagctgatgatggcgaaaaccaacgaagagttttttgaagtgatgaaacgttcgtaaaagcaaccgcacttctatgaagaacaaggggaaaatattatgttttcccctttttaatatccgtaatatttgacgaaataaatgatgacagctgataagttcataaaaggggcaaaaggtaaaaattcttttttcttcctatgaataagcgaaaaacatattccaagcactgaggctaataataaaaagtgcggtaaggtttctaaatgaataaaacttcctaatgccattgctagccaataatctccccgtccaaaggcttcttttccataatagaattttgcaagccaatagattacgtagaaaacaataaaaaaacttgccgcactttttatgctttcagataacgtaagtaatgaaaagttattgtctgctccaaataatcctagagtaagtaaccataaacagggtgtcgtagaaataagttgatagtgccaatcaagataactgattgtccaaagaataataagtgtgagtccgatccatacagtaaaaatagaatctttgaaggcaatttgtaaaaatataaatccaaccccaatactaaaaaaatacctcaaaatatgrccgcactttttttgttgaatagaggcaaagtgcggttgaaatggagaacggttttgtggaaataattcaacgtaaatcgcataaatattttgctgcaaacgcgtaataaaaccagataggtagaaccacaatgcgatccctaagataccgcctaataaaaacattgtgaaataaatcattgaataacagaacccatattaaagataggtaaatacattcccatcataataattccaatcagactgccgatgatcaccatcattaatggttctagcatttgtgagagtaagtcaatttgatgattaagtttttcttggtaattttcagcaatatgctctagcatcaaagcgagttttccgctttgctcgccaatttgtagcatttgttgtgcttccatcgggaaaagatcgctacttacactattagaaaacgcatagccttgagaaacccattgcaaaattgaccgcacttctttatctaatacgatgtcatttacaagcgttttcttggtttgccacgtttgtgtgcgagggagaaaactgtctagtgcctgattaagcggtacgccagcttgcaacataatttgtaaactttgactaaagttcactaaacgtgaaagcttttgaattgtgccaaaaataggcgtgatagaaataagttgattttycttttgataaaaccaagtctggcgttttagatagaaataataaaatagaaaaaaactcaaaacgaaaaatagcaaaatgccaatattttgcttaaggaaattagatattgagagcaatattgcggttattgttggtaactccgcattgttgccactgtacatttcagcaaattgaggcacgataaaaagcagtaatgcgagtgtcaataatagagaaattcccaataccattgagggatataacataattttctgtaatttacgttgtaatgctaaagattggctgcgatgtgtggctatttttttacaaactacggcaagttttcccgtcatttctcccacttgaatcagttgaatttcttgttgtgtgagatatttcccttgttgttcaatggcttgtgagaatgctaaaccagattcaatagattgaagtagtcgttcaagccattcattgagtacaatttgagtacaattttgttgcaaaatttgcagactgttttttaacggaatagcggattgtagcaacgtggctaattgattgagtaattcgctaatttctgaatttttgggctttgccnaaattgccagttttgttgtaatttgatgtgagtaagcccgcggcttattaattgaaagtgtgcttgttgttttgtatccgcaataattgagcctttttgtttctgatttaatgggttactagcttgataataaaagagttttttagtcataaatttttacctaacacacgttcaatttctttctcatccgttatgccttggctaactttttctaaaccactcgcacgtaaatttttaaaatccgtttgatagtcattctgctgccaatgtagaaattgatacacgccgattcgacctcgataaccttgatggcaatcacaagaatttgctaaatttccaccgcactttgaacaaagctttcgtacaagacgctgtgcaataacgagcaataaactgtttttaatttcatactgttgaataccgagttgttgtaagcgagaaatagcagaaattgcatcattggtatgtaaagttgaaagcaccaaatgcccagtttgtgccgcacgtaatgcaatcattgcactttcttcatcgcgaatttcgcctagcataataatatcgggatcttgacgtaaaaaagtgcgtaataggcggttaaaatctaatccaatctgtggattaatttggctttgaataatgccatcaagctcaatttcaatgggatcttcagcagtcataatatgtttatcaggcgtatttagccattgaagtgcggtgtaaagtgagatactttttccacttcctgttgggccagtgactaaaattaatccttgtggctggctaagcacacgttgaaatgcttgttgctgattttctgtcatacctaattcagaaaagctaagttctactggtttattttgttgcgctcgcaacacgattttctcgccccaatgggttggtaaggttgaaaggcgaaaatcaagaatatcggaaaaagtcgttttaaattgaaatcgcccatcttgtggaagtcgattttcactaatatctaatttagccagtaattttaagcgtgaaataatacgattggcgaatattttgcttattaagggttgtggttgtaaaactccatcaattctaaaccgcacttgaaattgatcagccaaggtttctaaatgaatatcagaggcatttttttgtaaggcagattcaaaaatctgattaagtaagcggataacaggttcatcatcttcttgttcaaaatgggtttcttgatgttgatagaatttaacttgttcttccacttgcatttggttcggagtaagttgttgtaacagttctttgagttggctgctttctaacaaaattggttcgacaggttttcccgttataaacgcaatggtttcacaggctgaaagattggagagagaatcaacccctagccagagacgattattttcttctttaagtggcaaagcaaaataacgtaagagcaaggattgttgctgctgattgcgttcccataaatctggcgagatcgtaaatacttcgccatttttagcggttacacgctgagtatgaagtaaagcatagctcgtcattttgtgacacttccgcaaaaatttgctggaaataaagaggcatccgttcctttgcaggttgttgtccaagttacacctgctgcagcattacctttagcttgcaaaatatattccatatttgccaatgtgccattcccttttactgtaataccacctgattgagtgataactgaggctacatagccttttgctgtctttatatccgctgcaataccattttttccccctgtacagcttgttgtttcatttgtgctatatacacataattccacatcagccttataaggcgcagacgcttgcagtaattcggataccgcagcttttttggtataattttgataagaaggaattgcgatggtggctaaaatagcaataattgcaatcacaatcattagctcgattaatgtaaacccttttttcaaggtttgcagtgttgttaatttcattcattttccttttattaagcctttgttggcaacgacattgtgaaaaggaaaaatttgtttgtaaaattgaccgcactttttctgcgatcctgatcgcaaaaaaaaggaaaaatgtatgcgaaaaataaaagatattgagaaaggattgctgaccgattgtcggcaaattcagtcacctcactttgataaacgcccaaatccgcaggatatttccttattagttattcattatattagtctaccgccagaacaatttggcggcggatatgtggatgacttttttcaagggaaattagatcctaagattcatccttattttgcagaaatttatcaaatgcgtgtttcagcacattgtttgatcgaacgaaatgggcgaattacgcaatatgtcaattttaatgatcgcgcttggcacgcaggcgtatcgaattttcaaggacgagaaaaatgcaatgattttgccattggaattgagttggaggggagtaatgaacagccttttaccgacgctcaatatttttcattgcaagaacttaccaatgtaataatgaaaagttacccgaagattactaaagatcgaattgttggacattgcgatatttcgccgaaacgtaagatcgatcctggtcaatattttgattgggaacgttatttatccagtgtgaaataatctgtataaaaattaaacatcaaattttgggtattctgtgtattctaaatgcgttcattcttttacttctaaccagttgaattaaaaggaataaatttaaagctgaaattttattaaaaaagttaatttgagttatacagtattatagattttctcaaccacaattttatccacagaaatattgaataactcaaagagatggtaaaaagatcttttgtgaataaaaccattttaaaaattgtatttttttaccgcactttattgcatttttgtatgtaaaaagtgcggtttatttttatttaagatcttttggttacaaataacccgatttattttgaagtttgatgtgataaggatctttgccctctttttacgagatcaattcacaatcaaaaatccattattcacaagttatccacnacatagatacttttcgtcatataaacaaaataagaatattttgttgtctagaattttcccctctccgtaaaaattgtgtatttttaaccgcactttaggtttaaacccaatgtgcggttattttttattgattttcctcttttcgcgttttgcgattttttctaaaatatgataatttttcgccgtcaataagacatcaaacacaaatcaatatgaacgacgaacagcaaaattcaaaccaatctgaaaatacaaaaaaaccttttttccaatctttatttggtcgcttttttcaaggcgaattaaaaaatcgtgaagaacttgtggaagtgattcgcgattcagaacaaaatgatttaattgatcaaaatacgcgcgaaatgattgaaggcgtgatggaaattgcggaacttcgtgttcgcgatattatgattcctcgttcacaaattatttttattgaagatcaacaagatttaaatacttgtttaaacacaattattgaatccgctcattctcgttttcctgtgattgccgatgcggatgatcgcgataatatagtgggcattttgcacgcaaaagatttattaaaatttttacgtgaagatgcggaagtctttgatttatcttcattattgcgccccgtcgtgattgtgccagaaagcaaaagagtggatcgtatgttgaaagatttccgctcagagcgttttcatatggccattgtggtggatgaatttggtgcggtatcaggtcttgttaccattgaagatattttggaacaaattgttggcgatattgaagatgaatttgatgaagaagagattgcggatattcgtcagctttctcgtcatacttatgctgtgcgtgcgctcacagatattgatgatttcaatgcgcaatttaatacggattttgatgatgaagaagtggataccattggaggtctgattatgcagacttttggttatttaccaaaacgtggggaagaaattattttgaaaaatcttcaatttaaagtaacttctgcagatagtcgtcgattaattcaacttcgagtcacagtgccagatgaacatttggcagaaatgaataatgtagatgaaaaatctgaataggattttattatcaattaaatttatgaataaatattttacttatcttattgcgattatatcaggtttactcggcgtttttgccttttcgccatttgattattggcctttagcctatgtttctttactcggtttactttatgtcgctaaaaatcctaaaaaatccaccgcacttttatccactttcttgtgggcgatgggatttttctgctttggagtaagttggcttaatgtcagcatccatcaatttggtggtgcatcgttaggggtaagttatttccttgtcggtttacttgcggcttatcttgcactatacccgatgctatttacctatttagttcatcatttcaaagtgcaaagtgcggtaatttttgccgtgatttggacattgacagaatttttacgaggttggatttttaccggttttccttggcttcaatttggttatacgcaaattgacagcccattttatggcattgcccccatttttggcgtaacaggattaacgttctttactgtttgggcaagtgcggtcatttttaatctcgtttcctctttgtttaaaacgaaaaaccttaaattagttttagcgaatgctttgttattgatcatcgtggggggattaagtgcttattcatcccgaattcactttgtaaaatctgttgaagataaggcaatttcagtcacgcttgcacaaggtaatattgaacaaaatcttaaatgggatcctaattatttctattctactttggcgatttatcaaaaattaatcacagaaaatcttggtaaaaccgatttaattattttgcctgaatcagccttgccaacgcttgaaaatgcgattacgccattttttgagggattagagcgtgcagctaaagaaacgaaaacggaaattatggttggaactgtattccaagatacaaaatctggtaagttattaaattcaattatgactgctggaaacccagattttccttatcaaccaaatacgcaaaatcgttataataaacatcatcttgtgcctttcggggaatatgttccgctagaaagtattttgcgaccacttaattcagtgtttaatttaccaatgtcagcatttcaaagtggggaggcagttcaaccctctttaatcgcaaaaaaacgtgctttttcgccagcaatttgttatgaaattattttcggtgagcaagtgcgacaaaatttgaaacaagatacggattatttgctcacgttatctaatgatgcgtggtttggcgattctatcgggccttggcaacatttacagatggcaagaatgcgtgctttagagttaggcaaaccgcttattcgtgcaacaaatacggggatttcagtttttgttgatgcgcaaggtaaggtattagcacaagccccgcaatttattgaaacaactttgacttataaaattgcacctgcggaaggcaaaaccccttattctgtgttaggaaatatgcctttgtatgctttatctttattgtttttactcttgcacagtatgatggcgtttattcgtcgtaagatgaatatcttataaaaacaccagttaaaatgaccgcactttttcattcatataaataaacattatgcgcataccaagaatttatcatccaatatcccttgaaaatcaaactcaatgttatctttcagaagacgcggcaaatcacgttgctcgagtgttaagaatgacagaaggcgaacagcttgaactctttgatggttctaatcatatttatccagcaaaaattattgagtcaaataaaaagtccgtaaaagtagagattttggggcgtgagcttgcggataaagaatcccatttaaaaatccatttaggacaagtgatttctcgcggagaacgaatggaatttactattcaaaaatccgtagaattaggggtaaatgtgattacgccattatggtcagaacgctgtggcgtaaaacttgacgcagagcggatggataaaaaaatccaacaatggcaaaaaattgcgattgcagcttgtgagcaatgcggtcgtaatattgtgccagagattcgtccactgatgaaattacaagattggtgtgcagaaaatgatggtgcattgaaattgaatttacatccacgtgcgcactattctattaaaaccttaccgactattcctgctgggggtgttcgcttattaattggctcggaaggtggattatcagcacaagaaattgcccaaactgaacagcaaggatttactgaaattttattaggaaaacgtgttttacgcactgaaactgcatcacttgcagcgataagtgcattgcaaatttgttttggggatttaggcgaatgatggaattacaaggaaaatttttgatcgcaatgccacatttagacgattattttaatcgcacggtggtgtttatgtgtgagcataatgaacagggttcaatgggtttggtaattaatcagccgacagatttaagcatcgcggaactttattcaaaactcaattttatgatgaaaaatgaccgcacttttggtaatgaaatggtggttgcgggtgggcctatgcatacagaaagagggtttattttacataagaatacgcttaatgcttttcaacatacttacaaagtcacaaaggaactttcaatgacaacctccgctgatgtggtggaaacgctaggttcaacttttgcacctgaaaaatatcttgttgcgctaggatgttcaagctggggggctggtcagttagaaaaagaaatcagagataatgcgtggttggtggtgtcatctaacgatcaaattttatttgatatgccctatgaagatcgttatgctgcagccaatcagttacttggtattcatccttataattttgcgttagcgcaagtggggcatagttaatgggaattaccgctctggcttttgattttggcactaaaagtatcggttgtgccataggacaaagtattactggcacagcacaagccttgcccgcttttaaggcgcaagatggcatcccaaattgggaagcgatcgaaaaatgtttgaaagaatggaaaccagatgttgtcattgttggtcttcctctaaatatggacggaacagaacaagatctcactctacgtgctcgtaaatttgcaaatcgtttacaaggtcgttttggcgttaatgttcatttacaagatgaacgattaaccaccacgcaagctcgtagtgagatttttgaacgtggtggttttaaagcattaaaaaaaggcaaaatcgatggagtgtcagcttgtttaattttagagagctggtttgaatacgctgaatattagattcacattgtaaaaataaacttcattttagaatgattaaagcgcgattttataatctcgctttttcgccaccaaattcatctaataaattttcggtgagtttggctaaaataccagtcatcagtacaaaatctgcatcgaaacgctgtgcaaaatcttctttcagaatatcatcatttttttcccgtacagtatctgcaaattttaaacgtttgattgtgcaatcttcgttaaaaacgaaagttaaggtatcttcccattctaaggctaatttacttactacttttttgccatcttgcagaagagcgagaatttcttcattttctaagggttgttttttacaacgaataacgctgtcttcctgactgccacgaagctcggcttcttctaatgcaagtaaccaatgcggcaaattatcttgaaggatccaattggttaaaatcgtgctgggttcattagcaaaggctaaaggcacgacagggagcgaacctaaggatttacgcagtaatgcgagcgcatcttccgcgcgtttacttgatgcggcatcaatatgaataagattattttccgtatcaatccatagtgccgtatgctgatttttactaaatgcacgaggtaataaattcatcacgacatcatcttttaatgtttgtttttctacctttttaagtttgcgattttctttttgttcaaggctttcaatgcggtcatctaattcacgtttgaccacatttgccggcaagattttttcttcttttttggcgattaatagaatttgttttccaacagaaaaatagagtaaatcacttcctcgtaatggagcagaccagccaaatttactttgatcttgagtgccgcaaggatggaattgacaatcttccagttgagtttgtagctgtgcaagatcccaatctagcggtttagtcagtctataagtcattaaatttttgaaccacatcgtaacacttccttcaatatagggtagaatgtgcggtattatagcccataaaagtaggaaaaacgatgcaacacaaattgattgcctttattggtggcggcaatatggcacaagctattattcttggattattgaaacaaggttatcctgccgagcaaattattgtgaatgatccaaatgaagaaaaaagagcattttttgctaatcttgacgtggcaacttcagaaaataatgtgggaagtgcaatcaaagctgaggttgtgttgcttgcggtaaaacctcaaatgatggctgaagtttgttcgccactaagtgcggtggatttttccgacaaattgttaatttccattgctgcgggtatttcaactgaacgcttgaacgcattaattccaagcgtaaaatcgatagtacgcgtcatgccaaatacgcccgcattggtgggggaaggtatggcgggtttatttgcaccgaaaaatacgagtgaaaattaccgcacttttgcacaagatttattgggagcagtgggaagaacggtttgggtgaatgatgaaactcaaatgcacgcagtcactgccgcgtcaggaagtagccctgcctatttctttttaatgctggaagcaatgcagaaagccttaatcaaaatgaatattgatgaaaaaacagcgcgtgaattagtccagcaatctatgcttggtgcagcaaaaatggtgacagaaaatccgcaaattgcactttcaactttgcgtgaaaatgttacctcgaaaggtggcactactgcggcagcgttagcagtatttgacgcacaacattttaatcaaacaatagagcaagctatgcaggcttgtttgtctcgttcacaagaaatggaaactttattctaatgcaagtccgtcctttttattggctcgcactgagctttctaggttactactgcgcttatggcgtgtttttgccgttcttccccgcatggttgaaatcgcaacaatatggcgaagaaatgattggtttggtgatcggtagtgcttatattttccgatttgcgggcggattatttttttcatcgctgattaaaaaagccaatcatattattattgccttacgcctattggcgttagcatcggcaattattatggcggctatgagtttagttgcgcataatttttggctgttatttattgctatcggtttgtatgcttctgtgaattcagcaggaatgccgattggggattcgttggcatccacttggcaacgccaaatcggcttggattacggcaaagtacgtttaattggctctgctgcttttatccttggcgtagtggtgttcggcggcatgattggctgggttggcgagcaaaatatcgtgtggattttaaccgcacttttatctttctataccatcattcagcttttaaaacccaccattcccccaaaagatgaaatacctgaagatagcgttcaaaatgatgttggttttattgctttactgaaaaatccgatgacattgcgagttatgatagcagtagggctgattcaaggctctcatgcggcttattatgtttatagcacgatttattggacaagtattgggatctccgtttctcaaactagcttactttggggcattggcgtattagcggaaattgtattatttttcttctctcgtcgcttattccaaaatatttctatcagtgtgctgctttatatttctgcgcttgcgtgcgttggacgctgggctgtaataggatatattgaagatttctggttgatattcttattgcaacttatgcacagtttaacctatgccgtttgccattatgcgattgttcgctatatcaccacgcaaccgcaaagccatattgcgaagttacaaggtttgtataatggtttatccaatggtgtgctcattgctattttcactgcgattgctggcatgatttatccaacgtcgccagcgatgacatttgtatttatgagtatcattgcagctgctgcattttttgtgattccacgtaagttaaatgcctttttgattgttcagcataaataggacgcattgctttccttgtagaaaagtaatatgaaaaatcttgcgctcattgatttgtttcttaacgaatattggattgaaaaagggctttcagaaaataccgttcaatcttatcgtttggatttaaccgcactttgtgattggttggataaaaacgacttgtctttggaaactttagatgctgttgatttgcaaggttttctaggagagcgtttggagaaaggttacaaagccacgagcactgcgcgaatgttaagtgcaatgcgtaaacttttccaatatttatatcgggaaaaatatcgagtggatgatccaagtgcggtgctaagttcgcctaaattacccagtcgcttgccaaaatatttaaccgagcagcaagtgtcagatttgctcaatacgccaaatgttgaagtgcctttggagttgcgtgataaagcaatgttagagttgctttatgcaacggggcttcgtgtaacggagttagtttcgcttacgattgaaaacatgagcgtgcaacaaggcgtggtgcgagtgattggtaaagggaacaaggaacgtattgtgccaatgggggaagaagctgcctattgggttcgtcaatttatgctttatggtcgccctgtgctattaaatgggcagagttctgatgttgtgtttccaagtcagcgcgcacagcaaatgactcgtcaaactttctggcatcgtgtaaaacattatgccattctcgcggatattgatgctgatgcactttctcctcacgttcttcgccatgcttttgccacccatttagtaaatcacggtgcggatttacgcgtggtgcaaatgttgttgggtcatacagatttatctacaacacagatttatactcacgtggcaaaagaaagattgaaacgattgcatgaaagatttcatcctagaggataatttcggggtaaatttttatagttttaaagattgattgtggatttcttattgattaattaatttgacacgcatcacaaattttgaataaaaaattagacagctcaagcatattttgctatcttgcgaaaaatttcgacatttgttctatcgaaaagtaattttggattctaaaatgaaaaaaatcacgcttttttttaccgcacttttatgcttattttcaacttctgttttagccgaatctaattcaatacctaaacaatgtgaacaactatttaaagaaacagagaatttgattgcccaagcagaaaaacaacctggaacccacattcaagtaaataaaatcaaaagtaaactaaaccaaagcaaacaacaaattcttcaaatggaattagcgactcagttaaaaagttgtgaagtgggtttagcaaaattaagtaacttgaaaagttatagtgagtaattaaaaaagccttattgagtacaataaggcttttttagtggttaaatttatctagtctgataatttctgcaaaccaaaatgacgataagtttgcgatgttgcaatacggccacgtggcgttctttgtagaaacccctgttgaatcaaataaggctctaacacatcttcaatggtatcacgttcttcgccaattgcagcagcaagattatctagccccacagggccaccatcaaaacgctcaataactgcagacaacaactttctatctaaataatcaaatccagcatcgtctacatctagcattgaaagtgcttgttttgccacatttatagaaataataccgccattacgtacatctgcataatcacgcacacgtcgtaataaacggtttgcaattcgaggcgtgcctcgtgaacgacgagccacctcaaaagcggcttgttgttctaattcaagatttaaacagcccgcacttcttgcaacgatagatgttaaatcttctacagaataaaactccaaacgttgcacaataccaaaacgatcacgcaatggagaagtcaaagaacccgctctagtggtcgcgccaaccaaagtaaaagggggcaaatctaatttaatggaacgagcagcgggtccttcgccaatcataatatccaactgatagtcttccattgctggataaaggacttcttcaatcgcaggggaaagtcgatggatttcatcaataaataacacatcatgcggttcaagattggttagcattgcagccaaatcgcccgctttttctaacacaggccctgatgtcgtacgaatattcacgcccatttcatttgccacaatattagcaagggttgtttttcccaagccaggagggccaaaaatcaataaatgatctaaggcatcttgacgtagtttggctgccttgatgaaaatatccatctsstcgcgsacttgcggctgcccaacataatctgctaatagtttaggacgaatagsacggtcaataacatcttcatcaaccttagcttgcccgctaataattctatctgcytcaatcatatttttcctacaatgcgacttttaatgcttcacgaataacttgttcactggttaattcaggtttagcaacgcgttttaccattttttctgcttctacaggtttataacctaaagcaatcaaggctgaaattgcttcatcagatgaactttccgagtgggattcaatagatggggataatggaatatgcgtactttctacaaagaaatcgctttgttttacgcctttaaatttacctttgagctcaactaacaaacgttcagctgtttttttgccaacacctggaattttagtaagtttagaaagttcttctctctctattgcataggcaaattgttcgaccgacatggcggataaaatcgctaaggctaatttaggccccaccccatttgttttaattaattcacgaaataaagtgcggtctgttttctgggcaaatccaaagagtaagtgagcatcttcccgaacaacaagatgggtgaataaagttgtttcttgtccaatttctggtaaatcatagaaactcgtcatcggcaaaagcaattcatagcctacgccttgcacattgagtaaaatttctggaggttgtttttctaaaagaatgccttgtaagcgaccgatcataattcttccgaatgataaaaaaattaacgcatagaataaaataaaactggacgaacatccagttaaatttttaatctaaagcgtcctcggctatatctggtctttaaaagtgcggtcattttttcttgcgtttctgtcattttcacagaattggcaatatgtaaagaatgttgaatagaatgcgcgtgtgtaatcgcaatagccaacgcatccgctgcatcggcttgaggtttatctgacaacttcaaaatacgagtcaccatttcttgcacttgcactttatcagcggaaccaatgcccaccactgtttgttttactaaacgtgcggcatattcaaaaacaggtaaatcattatttaccgctgcaacaatcgccgtgccgcgagcctgcccaagtttcaatgctgaatccgcattcttcgccataaacacttgctcaatcgcaaacatattaggttgaaattgcgtgatgatttcagttactccagcataaatgcgtttcaaacgggtgggtaaatcttcaacttgagtacgaattgcgccactaccgagatattctaaatgttttcctgtttgacgaatcacaccgtaaccagttacgcgagagcctgggtcaatacctaaaataatgctcataatttctataaaaaatgggtaattaaattacccatttattgcatcattaaagttgagatgccacttcgtcacagatttctccgttgtgatatacgttttgtacgtcatcacaatcttccaacatatcaattaaacgaagtaattttggtgcagtttcaatatcaagatcgacggttgttgatggaatcatcgttacttcagcttcttgtactttaaaaccagctgcttcaatgccatcgcgcactgaacctaaatcttcccaagcagtatagatttcaaatgaaccatcatcttgtggttgaatatcatcagcacccgcttcgattgccgcttcagttaaggcatcttcatccgcttctgcgattaagattaaaccttttttgctaaataaataacccacagaaccttctgttcccaagttaccaccacatttagtaaaacttgggcgtacttgtgagatcgtacggtttgcattatcacttaaacattccaccataaccgctgtaccgcctgggccataaccttcatagattttggtttccatattggtatcatcgccaccgcctacaccacgatcaatagcgcggttgatagtatcgcgcgtcatattgttgctaagtgctttatctactgctgcacgtaaacgtgggttagcactcacatcgccaccaccaattttagctgcggtaacaagttcacgaattaatttagtaaaaattttaccgcgttgtgcatcttgtgctgctttgcggtgtttaatattagcccacttactatgacctgccattttatttccttctgttttgatcttattgatcttgatttaattaaacgttttgacctaggctaggtatagcctaggttagtaaaagtgttaccccgttgggagtggatgtagcttttcccaaaagagaaccgctatcaccataattagctgtgattatacttacctacggagattaaaaagatattttttaatagcttccgcattattctgggatttcgtcatttctactgcttttttcgccgacacccagsaaaaatctaaatgctcactcaatactggaataaattctttttccacctcacacaaaaaccaatgttctttgcagtgagtaatattcggtgcgtatttatagcggaaatgtggaaaaatttcaaattctatgctctcattgcaatcaaaaagtgcggtggaattttccgaaatgtctaaccgcacttcttcccatagctcacgaattgctgttttttttggtgtctcatcactttcaatagtgccagtaacagactgccaaaaatcaggatcatcttggcgttggagcattaaaactctgtttgtatctttagtgtaaattacaacgagaacagattgattatttttgtattgcatcattaaaaatgcggtcaaatctgaccgcacttcattcctaatatttcaaacttattctgctttaacgacagaaattgccaactcttccaatgcttgcggatttgcaaaactcggggcttccgtcattaagcacgctgctgccgtggttttcggaaaggcaatcacatcacgaatgttttccgtgcctgttaaaagcatggttaagcggtctaaaccgaatgctaaaccagcatgtggtggagtaccaaattttaacgcatctaataagaaaccgaatttctctcgttgttgttcttcgtcaataccaagaatacggaacacagtttgttgcattttcggatcaaaaatacgcacagaaccaccacccacttcgtagccgttgatgaccatatcgtaagcattggctaccgcacttgttggatcagcctctaattgctctgggctgaaatcttttggtgaagtgaatggatggtgcattgctgcaagattaccttcttcatcacgttcaaacattgggaaatcaatgacccaaagcggttgccattcgtctaaacgagttaagccaagatcacgacctaatttcaaacgtaacgcacccattgcatcagtggtagtttgccatttgtctgcaccaaagaataaaatatcgccagtttgtgcattcacacgttctgctaaccctttccatacatcttcatttaagaatttcgcaatcggactttgcacgccttcaagaccagcattaatatcgtttacttttgcccaagccaaacctttcgcaccgtagatgcctacaaattgtgtatattcatcaatttgtttacgagtaatttctgcaccatttggtactcgaatgactgcaacacggccatttggattgtttgctggctcattaaatactttaaattcaacatctttgacaatatctgctacatctaccatttctaatggattacgcaaatctggcttatcagaaccaaaacgacgcattgcttcttgccaagtcatcactgggaatttacctaagtccacaccaatggtatcaagccataagccgtgcaccatgcgttccataatttcgcggacttctggcgcagttaggaaagaagtttccacatcgatttgagtaaactcaggctgacgatctgctcgtaaatcttcatcacggaaacattttacgatttgataatagcggtcaaaaccagacatcattaaaagctgtttgaaaagctgtggtgattgcggcaatgcatagaatttgcctttatgcacacggcttggcactaaatagtcgcgcgcgccttctggcgttgctttggttagcattggggtttcaatatcaagaaaaccattatcatccataaagcgacgcacaaagctggtgatttttgcacgggttttcaaacgctgcgccatttcaggacgacgtaaatctaaataacggtattttaaacgttgttcttcggtgttattttggttgaagtctaatggtaaaacgtcagaagcattgtagatgcgtaattctttcgctaacacttccacttcgcctgttgccatatttttattaatttgattatcaggacgagcgatcacctcgcctttaatttgaatacagaattcattacgtaacccagcagccgctgtcaatgcatcttgatatttaggatcaaaacaaacttgcacaataccatcacgatcgcgcatatcaataaaaatcaagccacctaaatcacgacggcgatgaacccaaccgcttaatgttacgtcttgtccgatattgttacggtttaatgctccgcaataatgtgtacgcatcatttcaaaatcctttgtactcttttaattatgctcaaaaatctgtcgcaattatagcggaaaaccaagagagataaaaaggttatttatgctgacaaatcaatcaaaaaagcaaagaaaagtaataaatattcaaaataaaggcttttttgtgccatatcatcagattttttgttatattatgccgcttgttgagattaaattacgttaaggataaccacatgttatttatcaatattacttttgcctgtattttagcgatccgtttttacagtctgtctatttcaattcgtcatgaaaaagcactcattgcaaagggtgcaatacagtatggtaaacgcaattccacactgttgtccattgcccatgttgcattttattttgcggcgatcattgaggctaataagcaaaacctgtcatttaatagcacttcacaaatagggttggcgattttaatttttgctattgcaatgctattttatgtgatttatgagctaaaagagatttggacagtaaaaatttatattttaccagaacatcaaattaatcgatctttcttgtttaaatacgtacgtcacccaaattatttcttaaacattattcccgaattaattggtttatcgcttttctgtcaggctaaatataccgcattggttggactacctatttatttgcttatcttagccgtgcgtattaaacaagaagagagtgccatgtcgcatttatttcctaaatcataatttataaatttcttctaaaagaacgactctttctctctgcctttaacacattatggtaaaagatactctattttctacccccattgctaaattgggggatttcatctttgacgaaaacgttgctgaagtctttccagatatgattcaacgttccgtgccgggctattctaacattattactgcaatcggtatgctggctgaacgtttcgtcacggctgatagtaacgtttatgatctaggttgctcacgaggagctgccacactttctgcacgtcgaaatattaatcaacccaacgtnaaaattattggtatcgataattmctcaaccgatggttgaacgttgtcgccaacatattgcggcatatcatagtgagataccagtagaaattctctgtaatgatattcgccacgttgaaattaaaaatgcctcaatggtcattctcaacttcaccttgcaatttttaccgcctgaagatcgcatcgcattgcttaccaaaatctatgaaggtttaaatccaaatggcgtattagtactttctgaaaaattccgttttgaagatactaaaattaatcatttactcattgacttgcaccatcaattcaaacgtgccaatggttatagcgaattagaagtgagccaaaaacgcaccgcacttgaaaatgtgatgcgtacagattctatcgagacacacaaagtgcggttaaaaaacgtaggattttcacaagtagaactttggttccaatgctttaattttggctcgatgattgcggttaaataaaacaacggtaatttgatcntcttgcttgcatacagcaattgaaatgattagtatatacttatttaaatacatagtatatacgagagggtaaatatgcttactaaagtgtttcaaagtggtaacagccaagctgttcggatcccgatggactttcgttttgacgtcgataccgtagaaattttccgaaaggaaaatggggatgtggtattacgcccagtttctaaaaaaacagatgattttcttgcgttatttgaaggatttgatgagacctttattcaagcacttgaagcgcgtgatgatttaccgcctcaggagcgagaaaatttatgatttatatgttagacaccaatatcattatttatttaatgaaaaatcgccccaaaattattgccgaacgagtatcacaattattgcctaatgatcgcttagttatgagctttattacttatgctgaacttattaaaggcgcctttggtagtcaaaattatgagcaatcaatacgagcaatagaattacttactgaacgagtgaatgtactatatcccaatgaacaaatctgtttacattatggcaaatgggcaaatacactcaaaaaacaagggcgacctatcggaaataatgatctatggttcgcttgtcacgcattgagtttaaatgccgttcttattacacataatgtaaaagaatttcagcgaattacagatcttcagtggcaagattggacaaaatagataattctgattttttattttacttatgacataatctgtttaactcaactaaaaaaggacaaaccaatgcaaattttacacactatgttacgcgtgggcgatttagatcgttcaatcaaattttatcaagatgttttaggtatgcncttattacgcaccagtgaaaacccagaatacaaatatacgctggcttttttaggttacgaagatggcgaaagtgcggcagaaattgaattaacatacaactggggcgtagataaatatgaacatggcacagcatatggacatatcgctatcggcgtggatgatatttatgcgacttgtgaagccgttcgcgcgagcggtggtaacgttactcgcgaagcagggccagttaaaggtggctcaaccgtcattgcttttgttgaagatccagatggttataaaattgaatttatcgaaaacaaaagtactaaatctggtttaggcaactaaagtgcggtcaatttttattgtatttttaataacgtagggattcctacgttattttatttttaagagatagattatgtccgattctcaagaaatcccttatcacaaccaattaaaaaatcgctttcgtggctatttccccgtcattattgatgttgaaactgcaggttttgatgcaaaaaaagatgcgttactcgaactagccgccatcacattaaaaatggatgaaaacggttatttgcatcctgatcagaaatgccattttcatatcaagccttttgaaggcgcaaatattaatccagaatccttgaaatttaatggtattgatattcacaatccactacgtggcgcggtgtctgaacttgatgcaatcacgggattatttcaaatggtgcgtcgaggacaaaaagatgcggattgccaacgttctatcattgtggcgcacaatgccgcttttgaccaaagttttgtgatggctgccgctgaacgcactggcgtaaagcgtaatcccttccacccttttggcatgtttgataccgcaagtttagcgggcttaatgtttggtcagactgttctcgttaaagcctgccaagcggcaaaaattccttttgatggtaaacaagcccattcagcgttatatgataccgaacgcacggcgaaattattctgctatatggtcaatcatttaaaagatttaggtggtttcccacatattgcgtctgamctagaacaggaaaaaacaactgaaaaagagaccgcactttaagaaaaataaaaaactggttgcaatcgttttatttttccagtagtttaaaagcaattcttatttggagataaaaaatgaacattatccgtcgtcaccatcatcaccattcaactgaataatctttcaggtttttggtgtgcttggaagatttcttccgagctgacaggataataaaaatcttacccctcggaaggcaactttcgaggggttttgttttatttacgatataggaggcattaatttagcgttattctttattcaataaaaattttaaagtaaagtatttatcatttaatttacaaggaaaaacacaatgttatcaaaccctgttgttatctcaatcatcgttttgctggcacttagtttgctacgcatcaacgttattatcgcactggtgattgctgcgcttaccgcaggatttatcggtgatttaggtttaactaaaaccatcgaaacctttacaggcggcttaggtggcggtgctgaagtcgcaatgaactatgcaatacttggagcgttcgccattgctatttctaaatcaggaattactgatttaatcgcttataaaatcatcacaaaaatgaataaaacaccaactgctggcaatttaacttggtttaaatatttcatttttgcggtattggcattgtttgccatctcctctcaaaacttacttccagtgcatattgcttttattccaatcgttgtaccaccactactttcaatctttaaccgtttaaaaattgaccgccgtgcagtagcttgcgtacttacatttggtttaactgctacctatatattattaccagtaggctttggaaaaatctttattgaaagtattttagttaaaaacattaatcaagctggcgcaaccttaggtttacaaacaaatgtagcacaagtttctttagcaatgttgttacctgttattggaatgattttaggcttactcacagccatatttattacctaccgtaaaccacgtgaatacaatatcaatgttgaagaggcaacaactaaagatattgaagctcacattgctaatattaaaccaaaacaaattgttgcaagtttaatcgcgattgtcgcgaccttcgcaacacaattagtcacaagttcaactatcattggcggtttaattggcttaattattttcgtactatgtggcattttcaaactaaaagaaagcaacgatatttttcaacaaggcttgcgcttaatggcaatgattggctttgtaatgattgctgcttcaggttttgcaaatgtgattaatgccaccactggcgtaacagatttagtacaaagcctaagttctggtgttgtgcaaagtaaaggtattgccgcattattaatgcttgtcgttggtttattaattacaatgggtattggctcatcattctctacagtaccgattattacatcaatttacgtaccactctgtttatcttttggtttttctccattagcgacaatttctattgtaggcgtagcagcggctttaggagatgcaggttcgcccgcatcagactcaacattaggcccaacatctggcttgaatatggatggcaaacacgatcacatttgggattctgttgtacctacctttattcactataatattccattattggtattcggctggattgcagcaatgtacctttaacgattataatcccccacttgggggatttttttatgactgttcaacaacttatccaacgcttagatcaaaaagttcaacaactttatcaagctcatttatccaaacgagaagaaaaaatcttcgccaaatttgaccgcactttgttcagtgaaaatggacaaaatgtttccttttatctaaaagaaatcaatcaaacgctagatagaataaagacattagagtctaacgattctaatcactataattttctagctgagcgtttactcgccaatgttccgttctttcggaagctttagttcgcaaaaatactcatctaactgaatcccaaacaacaacgaaacaaaccattcaaaaatctcaacatagcattcataaattaccaccaagagaacgcctagaaaaatattacgaagcacgagaacaattgaataatctttatcgacagcataaagatttagcacaagctgaaaaaaataatgatgagaaaatacgttatgctcaacttgcagaagtttataaaaaacgccagcaaaaatgccaagatgcaatcgatcttttagaagaatatttggtgtttaaagaagaagtggaaaaccgtgaaaatacggaaaacaaatgattagaaataaaaaactaattcttccgaattagttagctcgtaaaaattgatggcggaggaatagggattcgaaccctaggagggcgtaaaccctcgccggttttcaagaccggtgccttcaaccactcgaccattcctccgtgatttaacgagcgtgaataatacgttctctaataaaaaccgtcaagtagaaataatctcatttttatcaagtgattatttttaccacagcttataaaaaatgcctttcctatttatgaacggaaaggcatttttgttgaatgaatttcagtgctttttattactacaatatatcgcagaaattaaccgcacttttgtcatctaaacaattattttacgcgagagacgtattcgccagagcgggtatcaactctgataacttcgccgatttggacgaaaagcggcacttttacaactgcgcctgtgcttaatgttgcaggtttaccgccagtgcctgcggtatcgcctttaagacctgggtctgtatcgacgatttctaattcaacaaagtttggtggcgtaacagtaattggtgcgccattccataaagtcacgatacaatctgcttggtctaataaccatttttctgcatcgcctacggcttttgcatctgcagagtactgttcaaatgtttctgggtgcataaagtaccagaatgcatcgtctttgtatgaataagttaagttaagatccataacatcagctgcttcaaccgaagtgccagatttaaagtttacgtctaatactttgcctgaaattaatttacgaatacgagtacgagtgaatgcctgacctttgcctggttttacaaattcattttcaacgatgacacaaggctcgccgtcttgcataaattttagacctggtttgaaatcactggtagtatatgtagccatatttgaaatatcctaaaaatgagagatggtttgaaaagtgcgtattttaccccaagaacccgtcattagagaagaacaaaattggctcacaattctaaaaaatgccatttcagatcctaaattattactaaaagccttaaatttaccagaagatgattttgagcaatccattgctgcgcggaaacttttttcgctccgcgtgccacaacctttcattgataaaatagaaaaaggtaatccgcaagatccccttttcttgcaagtgatgtgttctgatttagagtttgtgcaagcggagggatttagtacggatcccttagaagaaaaaaatgccaatgcggtgccaaatattcttcataaatatagaaatcgcttgctctttatggcaaaaggcggttgtgcggtgaattgtcgttattgctttcgccgacattttccttacgatgaaaacccaggaaataaaaaaagctggcaactggcgttagattacattgcggcacattctgaaatagaagaagtgattttttcaggtggcgatcctttaatggcgaaagatcacgaattagcgtggttaataaaacatttggaaaatataccgcacttacaacgtttgcgtattcacacccgtttgcctgttgtgattccgcaacggattactgatgaattttgcactttattagcagaaactcgtttgcaaacagttatggtgacacacattaatcacccgaatgaaattgatcaaatttttgctcatgcgatgcaaaaattaaacgccgtgaatgtcacgcttttgaatcaatctgttttgctaaaaggcgtgaatgatgatgcgcaaattctaaaaatattgagcgataaactttttcaaacaggcattttgccttattacttgcatttgctggataaagttcaaggggcgagccattttttgattagcgatattgaagctatgcaaatctataaaaccttgcaatctctgacttctggctatcttgttcctaaacttgcacgagaaattgcgggcgagccaaataagactttatacgcagaataagatccgataaaatacacataattttttcgccgcacttttgagcttctcaattttgtggctaattaatataaataagaacaagcatcagaggcaatccagtgaattctatggataaaaatcaacaatcatctcaaaatgaattggatttagggcttaatcaagagccaattacaccaaagaaaacaattcagccaagttcgtcaattttaggtaaagcaaaagggttatttgccaaaaaaaatcacgtgcaaactaactttcagcaacgtaaagaacctacttttggcgattcatcaacgcaagaaaatgatcctttaattccgagtgaaaatttgaaaaaagtgcaaaagcctgttcttcaaacttcttccacagaagaaaatatttctgcggttgatgaagaaatcagtgctgaaaataacgcggatgaacccgtcgaaaaggctgaaaaacctattttagctcaaccagaaaaatggaaaatattacaagtattgccagcaaaacatcgccgtttatttatggctatttttgtgttggttattttattgattattttcttcgcattaaaaccaagttctgacaccgttgagtcttttactcaatctaacagcaatgaagttcctgtgcagttccaatcgttagatcaaagtcagccactggaaaccacgattttagataatcctcctgcacaaaatcaaatggctgtagaacaagctaaccaatctgaatttgcaccaaaagcagaggaagcggcgaataatacgacggctcaaaacccattagtagaaaatgcgccaatgcaacaaaatgttgttcaatctccaagtcaaatgccaaatgaaatggctgcggcatctgttgcgcctatgcaaccagctcaagcggaacagccaaaagcaactgtgccagttcagccgatgaaaaaagcggtagagccacaagttgcgcataaagatacagtgaaaaaagaagtgaaagtggcggagaaagcacaggctccagcaaaagcaacggaacaaaacgtcgctaaaacagcaggaaacgcaccgattgttgaagccaaacctgttcaagctaaaaaagaaaagaaagttcaaatcgttgatgcaaaacctgtgagtaaatctacagcttctcgcctttcagcaaaaacattaactgtgccgaaaggtgtttcgctgatgcaactcttccgtgataatcaacttaatatttccgatgtaaacgcaatgagcaaagcgacaggggcgggaaatgttttaagtagctttaaatctggcgataaagtaacggtatctgtgaataatcaagggcgagtaaatgaaatgcgtttatccaatggtgcgcgttttgtgcgtcagtctgatggttcttatcaatataaaaaataattttttgggcgagtaatcgcccctttttctttttaagttcttttctcaaggtaggatttatgttgaaaaaaacatctcttatttttaccgcacttttaatgactggctgtgtgcaaaatgcgaatgtaacaacacctcaagcgcaaaaaatgcaagtagaaaaagtggataaagccttacaaaaaggcgaagctgntcgatatttatgtcaagatgatagagttgttcgtgttgtacacgccacgcataaaaaatacaaaaaaaatttgcattatgttactgtcacttttcaaggcgtatcagaaaaactaaccttaatgatttctgaacgtggtaaaaattacgccaatattcgttggatgtggcaagagcgtgatgattttagtacgctaaaaacgaatctcggcgaaattttagcaacgcaatgtgtctcacaaacaagtgaacgcttatctggacaataatcgtgcaaagcgaacttcaacgtggttttgttttgcatcgtcgcccttatagtgaaacgagcttattggtagatttattcactgaagaaagtgggcgtttaaccgtgattgcaaaaggggcgcgggcaaagcgttcatcttggaaatcggttttgcaacctttcacacctttattgttgcgttggacgggaaaaagcacattgaaaaccctcactaaagctgaacctgccgcaattacactgcctttacaacaaatcgccctttatagtggattttatgtaaatgaattactcactcgagttattgagtctgaaacgccaaatcctgcactttttcaacattatttaaaatgcttaacgggcttggcaacggaaactaatattgagccaacgttgcgtctttttgaatttcaactgttacaaattcttggttacggcgtggattttctgcattgtgctggttctggcgagccagtggatttctcaatgacataccgttatcgtgaggaaaaaggtttcattgcgtctttagtgaaagataatctcacgttttacggcagagatttgttagcctttgaagcccttgatttttccgatgatgcggtacgtcaagcggcaaaacgttttactcgtattgcactgaaaccttatcttggcgataaaccgctaaaaagccgagagttattcactcaaaatattttacttttaaaataatggttcttctttataccccaaagcaaaaaacaaaaaatgttcaaaccattacggctgatattcttgatttagattatcaaggtttaggcgtggcgaaaattaatggtaaaacttggtttattgaaaatgcgcttccgcacgaaaaagtggaatgtcgtattttggaagataaacgccaatatggacacgccattgtaaaaaaatggcgtgtaaaaagccctgaacgtttagaacctaaatgtgctcattttatgcgttgtggtggttgccaaggacagcatattcctattgaaatgcagagaaaagcgaaagaatctgcattgtttaaaagattaagtaaattacagtcagaaccgatttcatttcaacctatgatttgtggcgatgcttgggcgtatcgtcgtcgtgtgcgtttgagtttatggtttaacccaagcacaaaacaaatcgaaatgggctttcgtcagaaaaataccaacgatttaatacccgttcaatcttgcgaagtagcagaacctgcaattaattatttactgcctaaattaaccgcacttttagaaaaattttcagcaccgaaacagcttgggcatattgaattggtggctgccgataatggtgtcgcaatgttgttacgttacaccaaaaaccttgcggaaattgaccgcactttattgcttaaatttgctgaacaagaaaagttaatgctgtttttacaaagcgacaaaggcattgaacaaatctatggcgatgcaccttattatcaattttctgatggcataaaattacattttgatattcgtgattttattcaagtaaatagtgcattaaatgaacctatggtcaatacagcgttggattggcttgaattgagccaacaggattgtgtgttagatttattttgcggcatgggaaattttacgcttcctctcgccaaacgcgtgaaaagtgcggtaggaattgaaggtgtttttgaaatggtacaaaaagcagcgcaaaatgccgagagaaaccaaatcaaaaatattgaatttttccaagcggatcttgaccaatcctttgttgaacaaccttgggctaatcagtcgttcaataaaattttgcttgatcctccacgcagtggcgcagctttcgcgttaaatgcgttgtgcgagttgaaagcagagnaaattttatatgtgtcttgtaatcccgcaacattagtgcgcgatgcggaaattttatgtaattttggctacaagattgaaaaaagtgcggtgatagatatgttccctcatacggggcatttggaatcgataaccttattcactacaaaataactcggttattcggtacaatatccacccaaaataaaagcgacaggaagttgcttgctcttcatcaacaagggggtattatggttgctgttcgtggttctcatttgttaaatccgcaggattttgtgattgaacaatggtgcactggcttaaaactagcagaacaaacagaaaaaagtttgancgatgcgtggtattacgcacgtgatttaatgaatgcctaccccgatgaaatgaagaatgcgaccttgatgctgcagtctggcgtggaaatggtagaaattttgcacgaacttaatatggatgcggaaacattgcttactgccatgttgtttcctattgttgcaaataaattaacagactgggaaagtctaaaagaaaaatttggtgcgaaaattactaaattacttaaaggcgtgttggagatggataatattcgccaacttaatgccagtcattccgctaacgctctgcaagtggataatgttcgccgtatgttgttggcgatggtggacgatttccgctgcgtgatcattaaacttgccgaacgtattactttcttgcgtgatgcagagcatcgttgtgcagaggaagacaaagtccttgccgtcaaagaatgttcttatatttatgcccctcttgccaatcgtcttggaattggtcagctgaaatgggagttagaagattactgcttccgttatcttcatcctgaacaatatcgcgctattgctaaattattgcaggaacgtcgtcttgatcgtgaacattacattgctgatttcgtcagtgagttgagcggttatttacgtgaaaatatcgagcaagtggaagtctatggtcgtccgaaacatatttacagcatttggcgtaaaatgcagaaaaagcatcttgaattcagcggtttatatgacgtaagagcggtcagaattatcgtgcaaaaattacaagattgttacaccgcacttgggattgttcatactcaatttaaacacttacccaaagaatttgacgattatgtggcgaacccgaaaccgaacggttatcaatctattcatactgttgttttaggtaaaggtggcaagccaattgaagtgcaaattcgaacccaacaaatgcatgatgatgcagagttaggtatggcggcacactggaaatataaagaaggcaatacaggcagtatgtctgcctatgaagaaaaaattgcgtggttgcgtaaattgttagcttggcaagatgatattacggattcaggcgaagtgctggcagagttgcgtancaagtgtttgatgatcgtgtatatgtgtttacgccaaagggcgaagtggtggatttgccaacgggatctacaccattagattttgcttatgccattcatagtgaaattggtcatcgctgtatcggggcaaaagtggcggggcgtattgtgccatttacctatcagctacaaatgggcgatcaaattgatattattacccagaaaaatccgaacccgagccgtgactggctaaacccaaatttaggatttactcacaccgcaaaatctcgagccaaaattcaagcgtggtttaaaaaacaagatcgcgataaaaatattccagcgggtaaagaattactcgataatgaactcgcgcttttgaatttaagtattaagcaagtggaaccttatgcgttaccacgctataacttgaaaaatttggacgatctttatgcgggcattggcagtggtgatattcgtttaaataacttaatccatttcttgcaaagtaaattgattaaagtgactgctgaagaggctgatcaagaaattttacgtcatgttgctaacaaaagtgcggtcaattctcagcagaaatctgaaaagaacaatggctgtgtgattgtggagggtgtggacaatcttatgcatcatattgcgcgttgctgccagccgataccaggcgatgcgattgttggctatattacaatgggacgtggtatttctattcaccgagcggattgtgaacaattcttagatttgcaagcggctcatccagaacgcgtagtggaatcaatttggggcgaaaattacgcaagtggtttccatattaatatccgtattgtggcaggcgatcgcaatggcttattgcgtgatattacaacggttctagcaaatgaaaaaattagcgtattaggggtctcaagccgtgctgataccaaaaaacagcttgctactattgatatggaaattgaacttcataatgttgaaagtttgagtaaaatattggctcgattagcaaaattagatgatgttatcgaagcgaagcgtttataaaaataggaaaawttatgtataaaacgacggggctaacccatttaatcaactccactaaatattcattacaaggcttaaaaagtgcgtttaaaaatgaaacggcttttcgccacgaatgttttttagcctgcattttaattcctcttactttctttttaggcgaaacaaaaattgaaattatattgatgatttcttctgttttgcttgtgatggcgttagaacttttaaacagtgcggtagagacagttgttgatcgcattggtacagaacgccacgaactttcaggacgtgcgaaagatcaaggttctgcatcggtatttattgccctttgtattgtcggtatcgtttggggcggaattttattcttctaaccctccaaaagtgcggtaagtttttaccgcatttttgatttatccaatcacgtcaaaatcatttataaaaataaggaaaaatatgaccgcacttttaaaaattggtctggtgtctgtttctgatcgcgcatcagcaggcgtgtatcaagatcaaggtatcccagaattacaggcttggttagaacaagcgttagtagatcctttccatttagaaacaagattaatccccgatgaacagccagttattgaacaaaccttaaaagagctggtggatgaacaaggttgccatttagtgctgacaactggtggaactgggccagcaaaacgcgatgtaacgcctgatgcaacccttgcggtagcggatcgagaaatgccaggttttggcgaacaaatgcgtcaagtgagtttgcattttgtgcctaccgcaattttatctcgccaagtgggtgtaattcgtaaggaaagcctgattttaaatcttcctgggcaacctaaagcgattaaagaaaccttagagggcgtaaaagataaagaaggaaatgtgcttgtaaaaggcatttttagcgcagtgccttattgtttgcaactgattaacggcttatatattgataccaagcctgaaatcatcgaaagtttccgtcctaaatctgcaagacgcgaaaatctggagaaatagcatgaaaaaaatcgaagcaatgattaaaccctttaaattagacgatgtgcgagaaagtctttcagatattggtatttcaggtatgacaatcacagaagtacgcggatttggtcgtcaaaaaggtcatacagaactttatcgtggtgcggaatatatggtggattttctgccgaaagtgaaattggaagtggtagttcctgatgagcttgtggatcaatgtattgaagcgattattgaaacggcacaaacaggtaaaatcggtgacggcaaaatttttgtttatcacgttgagagagccatccgcattcgcacgggcgaagaaaacgaggatgcgatttagtgcaaaataatttaaatttacaccgcactttgcttggcattgctgcggtgattattatcttagctggcgtaaaattggcggcagaaatcgtggtgccattcttgctatcactctttatcgcgataatttgttcgccgataattaaggcgatgacccaacgccgcgtcccgcattggttagccattactttgctttttgtcttgatttctttggtatttttcttcttagtcgggttgattaacagcacggcaagagaatttacccaatctattccacaatataaagttttgctttcacaacgcgtgagtgatttaactggattgttgcaacgtttcaatctgcctttcacgctttcgcgtgaaactatccaagaaaattttgacccaagcatcattatgaattttgtaagccgagtattgctgaatttctctggtgtagtgagtaatgtgtttgttttagtgttggtcgtgatttttatgcttgccgaagcaccaacgatgaaacataaatttgcaatggtgattagttcaacccctcatgacgtagccaaagaagaacgccatattgatcgcgttttacaaggtgtaattggttatcttggcatcaaaagcatcacgagtttattgactggtgttggagtgtttattttgttggaagcctgtagggttcaatatgcgattttgtgggcaaccttgagtttcttgctgaattatattcccaatattggttctatcatcgcggctattccgattattgtgcaagccttattactgaatggttttggcattggctttggcgtggcaatcggtgttattgcgattaatatggttgtcggtaacattattgaacctaaaatgatggggcaacgattagggctttcaactttagtggtgtttctttcattactgttttggggatggctgcttggaaccgtgggaatgctactgtctgttcctttgacgatggcattaaaaattgccttggagtccagtcccaatacagcgaaatatgcctgtctattaggagatgtcgaagatttcaaatagattttagagataaaagtgcggtgaattttcaccgcattttttatgataagtcttgcggatcgacgtccaaaattaaccgcacttggctgtttttttctagttcggcttgttgatattctcttaatgctttttgcaacgtcattcttgatggatgctgcaataataactgccagcgatattgccccgcttttttgctgaacggtgcaggcattgggccaagcatttgtaatcccgtaatttgcttcgattgaaaaaaatctgcaatttggcttaagcaattttctgcaagatcagaatgtcgagcctgtgctttgattaacgcctgaaaagtaaaaggcggcaatcccattgaatggcgtaattgtaaggtttcttttgcaaaagcttggtagccatttgccaataaagtggtaagcaaaggatgatctggataatgtgtttgtagcaccacttcaccttgtttatcggcacgtcctgcacgtccagcaacctgaatataaagttgagctaaacgttcttctgcacgaaaatccagtgaaaataatgcactatctacattcactaaggcaacgagagtaacattcgggaaatgatgtcctttcgcaagcatttgtgtgccaatcaaaatttgacttttgccttgttgaatatcttctaaataaccttccaattttcctttacgcgaagtgctatcgcggtcgattcgagccacagaataatgaggaaatagagttttcaaggtttcttctaattgttctgtgccgagacctgtagtgactaaatgagtcgagccacaatcaccacattgtcgaggaatagttttctgtgcaccacaatgatgacaacgcaatacattttgatgctgatgataggtataaggtttttcacaatgcgggcattgtgcgatccaaccacattcatggcaaagcaatacgggcgcaaagccacgacgattcaagaaaagcaacacttgattgcctttttcgaggtgggctttcattcgttccaacaagggttttgaaagcccgttttgtatattttgatttttcaaatcaataacgaaatgacgaagtgcggtagaatttcccgctctttttgataaaactaaatgttggtatttgccgttttgtacattattaatactttctaaacttggcgtagcagaacccattaatactgaaatgttcagtttttgagccagtacaatcgccaagtctcgcgcgtgataacgccaactgtcttgctgtttgtaagacgaatcgtgttcctcgtccaaaataattgcaccaagattagaaaattgcgtgaacaatgccgatctagtgccaatcacaatagcactttgtccagagcgggcgcgatcccatacataaagccgttgcgtatcggttaaattagaatgcagcacatcaatttctacattgaaacgcactttgaaacgttgcaccgtttgtggtgttagcccgatttcgggtacaagcactaatacttgtttgcccgattttaaaatttcttcaatatattgcagataaatttctgttttgcctgaaccagtcacgccatcgagcagccatacattgaaaccagaatggaagagcagttggctgaaggctaaggcttgctgcttatttaaggttaaacgattttcagcattaacaattgggttattgcctaatctttgttgccagcttaggggatttgtttggatagtaatttcttcaataaaccctttggcttttaaggctgaccaaatggcagaggaaaaatcattattgcctttttcaagatcagtttcagataagtattgtagggcttcagcttgctttttcgagcgttttaattcgccttgtttaagggcatttttccccgcatccgtaattcgccaaaaagtgcggtcattttttaccgcactttcgccgttacgcaatttcacaggtaaggcttgaaataacacatcgcctaatcccgcttgataataatttgctgcccaatgaagccaatcccaataaatgggcgtaaaaagtggggctaaatccaatggttgaagaatagccttgagtttatcctctggcacgtccgattttgtcggaaaatcagccacaatggcgacacgtttttgagtgccaaaaggcacaagaacacgcataccgatttgtaatgaaacatcatcggggacgaaataatcaaataagcgaggaagcggcacagccagtgccactcggacaattttcataatcaaccttggaaaaaatttgccctattatacgagaaaaattggtataatcgccgccaattttttcacgaacaagatttttatgacacaaacttttgccgatcaaaaacgtaaaaccgttgaaaccgcagaatttaccgaagatggccgctataaacgcaaagtccgtagttttgttctccgcacaggtcgtttgagcgaatttcaaagaaatatgatgaatgataactggggaacacttggtttagattaccaaacggaaccttttgattttgcgaagatttatggcaatgataatccagttgtattagaaattggctttggaatgggaaaatcgctcgtggatatggcttttgctaatcctgacaaaaattaccttggcattgaagttcatactcctggcgttggtgcttgtattgcttatgcagtggaaaaaggcgtaacgaatttacgcgtgatttgtcatgatgcaacggaaattttacgtgacagtattgcagatggtgcgcttggcggtttgcagttatttttccccgatccttggcataaagcaaaacatcataaacgtcgtattgttcaaccgcactttgtgacacaagttatacaaaaattaggtgaaaatggttttatccatatggcgacagactgggaaaattatgcagagcaaatgctagaagtattaagcgcaaacaccgatttagtgaacacctcgaaaaatggtgattatattccaagaccagattttagacctttaactaaatttgaagccagaggttacaaacttggacatggtgtttgggatttatattttgtgaagaaataaatcagttttaggcaaactcgatgcctaattgatgaatttaatatagaatatgccttcaaatataaccttaataggagaaatacaatgtctaaatcttacaatcaacgccaacgcaaaaaacttcatctcgcggaatttcaagaactgggttttcttgtaaatttccaatttgcagaaggcactgcgattgaaactgtagatgaaaccgttgatcgttttattaacgaagtgattcaaccaaatggattagcttatgaaggtagcggttatttacattgggaaggtttagtttgcctagaaaaaattggcaaatgcgatgaaagccatcgtgaaactgtgaaaaaatggttagaaacaaatggtttgcaacaaattgaagtaagcgaattatttgatatttggtgggaatatccaacaaaagtagaataatctaaattgaaaacagcatagtcaaaattgctatgctgttttgttttaatcccttgcaaaattcattaaaccttagattttttgatctataacaaataaagttcaaataattgaaaaactacctattttgggttgttttcattcattcatcgtaaacacataatccgttgcctacagaagcattcagaaatatttgaaagacattatgaccgttgaaaatttacctcgcagacaatttttacgcggtaaattttcaacattgagctgtttagaaaataatcaaaaacagaattttgtgggtattaggccgccttggtctgtggaaaattctatttttgtagcacggtgtacgcgctgtggcgactgtctttctgtctgtgaaaccaatattttggtaaagggcgatgctggttttcctgaagtgcgttttgataatggcgaatgtactttttgtgggaaatgtgtagatgcctgtaaacagcctattttttatccgcgtgaccagttaccttggtcacataaaatcgacattagcgtagttgtttaacattgcaccgtattgaatgccgaacttgccaagataattgtccagctaatgcgattcgtttcaaattacaaatgggtggcgtagcacaacctttagttaatttcgatgcttgtaatggctgtggggcttgtgtacaaggctgccccgtgaatgcaataacaatgaatgatctaaaacaaaatgaataatacaaatttaatattagaaaatgcgagagattggcacgtngttggattgatcgtgcaaggtaatccaaaaaaattatcagcaattcaaaccgcacttttagcgattgagcatactgaaattccgactcttgatgaaaaacttggaaaatttgtggtggtaatgcaatcgaacgatcagcatctcttgcttgaaaaaatggaaagtgtgaaagatatcgacggtgtgattaatgtatcgttggtgtatcacgagcaagatgaacaaaataaatagttttaaaatcaaacgtttaacgtgggggaaaacgcgatgaatttaagtcgtcgagactttatgaaagccaatgcggctatggcagccgcaacggcagcggggctaaccatcccagtcaaaaatgtggttgcggctgaatccgaaattaaatgggacaaagcagtatgtcgtttctgtggtaccggttgtgcagtattagttggtactaaagatggacgtgttgtggcatctcaaggcgatcctgatgcagaagtaaaccgtggtttaaactgtattaaaggttatttcttgccaaaaattatgtacggtaaagaccgtttaacgcagccgcttttacgtatgacaaacggaaaatttgataagaacggcgattttncgccagtttcttgggattttgccgttcaaaacaatggctgaaaaattcaaagaagcgttcaaaaagaacggtcaaaatgcagtaggtatgtttagttctggtcagtctaccatttgggaaggctatgcaaagaacaaactttggaaagcaggttttcgttctaacaacgtagacccgaatgcgcgtcactgtatggcatctgcagcggttgcgtttatgcgcaccttcggtatggatgaacctatgggttgttataacgacattgaacaggcagatgcttttgttctttggggctcaaatatggcggaaatgcacccaattttgtggtcgcgtattactgatcgccgtatttctaatcctgatgttcgtgtcactgtactttctacttacgaacatcgtagttttgaacttgccgatcacggtttgatatttacaccgcaaactgatttggcaattatgaactacatcatcaattatcttattcaaaataatgcgattaattgggattttgttaataaacataccaaatttaaacgcggagaaacgaatattggctatggtttgcgtccagagcatccattagaaaaagacacgaatcgtaaaacagctgggaaaatgcacgattcttcttttgaagaattaaagcaacttgtatcagaatatacagtggaaaaagtatcgaaaatgtctgggttagataaagtccagttagaaactttagcgaaactttatgctgatccaacgaagaaagtggtttcctactggacaatgggctttaaccaacatacacgtggtgtgtgggtaaaccaattaatctacaatattcatttacttactggaaaaatttcaatcccaggttgtgggccattttcattaactggtcagccttctgcttgtggtacggcgcgtgaagtaggttcattccctcatcgtttacctgccgacttagtggtaactaatccgaaacaccgtgaaattgctgaacgtatttggaaattaccaaaaggtacggtttctgaaaaagtggggttacacacaattgcacaagaccgtgcaatgaatgatggcgaaatgaatgtgttatggcaaatgtgtaacaataatatgcaagcagggccaaacattaatcaagagcgtttgccaggctggcgtaaagaaggcaacttcgtgattgtttcagatccttatccaactgtatccgcactttctgctgacttaattcttccaacggcaatgtgggtggaaaaagaaggggcttacggcaatgcagaacgtcgtacccaattctggcgtcagcaagtcaaagcaccgggcgaagcaaaatcagacttatggcaattaatggagttcgcaaaatacttcacgacggatgaaatgtggacagaagacttacttgcacaaatgcctgaatatagaggtaaaactttatatgaagtgcttttcaaaaatggtcaagtagataaattcccattgagcgaacttgctgaaggccaattaaacgatgaatcagaatattttggttactacgttcacaaaggtttatttgaagaatacgctgaatttggtcgcggtcacggtcacgatttagctccatttgatatgtatcataaagcgcgtggtttacgttggccagttgtggagggtaaagaaaccttatggcgttaccgtgaaggctatgatccgtatgttaaagaaggggaaggcgtggctttctacggttatcctgataagaaagcgattattcttgcggtgccttatgaaccaccagctgagtctcccgataatgaatacgatttatggttatcaacaggtcgtgttcttgaacattggcatacggggacaatgacacgccgtgtaccagaattgcatcgagcatttccaaataatttagtatggatgcacccattagatgcacaagcacgtggtttacgtcatggcgataaaattaagatttcatctcgtcgaggcgaaatgatttcttatttagatactcgcggacgtaataaaccacctcgtggcttagtatttaccactttctttgatgcaggtcagcttgcaaatagcttaacactagatgcgacagacccaatttcaaaagaaaccgacttcaaaaaatgtgcggtaaaagtggaaaaggctgcgtaaaaaccatgtaaaaatcaaccgcactttattttctcccatcaataaaagaggaagatgaaagtgcggttaaaatctaaaaagaaaatgaagaaacccgcacttaatcctgaacgtagaaaatttcttaaagaagcaacccgtactgcgggtggtttagctggcgttgggattttgttgggattgcagcaaaatcaaagtcttgcgcgcgaaggtgtgccattacgccctccatttgctttgcaagatgcgaaagcgttttctgccgcttgtattcgttgcggacaatgtgttcaagcctgtccttatgacatgctgcatttagcctctttattatcgccagtagaagcgggaacgccgtattttattgcgcgtgataaaccttgtgaaatgtgtcctgatattccttgcgcaaaagcctgtcctagtggtgcattagatcgtcaagcaacagatattaatgaatcgcgtatggggctgtcagtactgttagatcacgaaacttgcttaaattatcaaggattacgttgtgatgtttgttatcgagtttgtccattaatcgataaagcgattacattggaaacacaacataatccacgttctgataagcatgccttatttattccaacagtacattctgatgcctgcacgggatgtggaaaatgtgagcaagcttgtgtgttagaagaagcagcgattaagattttaccaatggatctggcaaaaggtatgttaggtaaacattatcgtttaggttgggaagaaaaagcgaaagctggccattctcttgcacctaaagatatgatttcattgccaactcgaacaccagaaggaacaactgtaattcctgaaccagcagaacccgtgcttgcgcctattttagggagtggcaaataatggcaaatgcaccaaaatttgcagggaaagaatcgcgcgaaaaatggggctggtggtatgcaaaccgctttttgttttggcgtcgattaagccaacttagcantcttgcgatgtttttgagtggcccttattttggcgtgtggattttaaaaggtaattatagtggtagtttattactcgatactattccactaagtgatcctctaattaccgctgaaagcttggctgcaagacatttaccagatgctctcactttaattggtgctgcaattattgtgttattttacgcagtacttggtagtaaagtgttttgtggttgggtatgcccactaaatgttgtgactgactgtgcagcgtggcttcgccgtaagttaggcattcgccaaacagcaaaaatttcgcgcggtttacgttatggtattcttgtgcttattttactaggcagtagtgtcagcggaatgttgctttgggagtgggttaatccagtggctgctcttggtcgcgcctttgtatttggttttggtgcaacaggctggttattacttgttatttttctttttgatttattgattgctgaacacggctggtgtggacatctttgcccaattggtgctgcttatggtgtgattggtgcaaaaagtttaatccgtattaaagtgattgatcgcgctaaatgcgataattgtatggattgttacaatgtttgtcccgaagcccaagtgttacgttcgcctttacacggaaaaaaagacgaaagcctactagtgctttccaaagattgcatcagctgcggacgttgtattgacgtttgcgctgaaaaagtttttaaattttcgaccagattcgatcattcaggggagtgattaatatgactaaacaggtatctaaaattttagcgggattatttaccgcactttttgctggctcactgatggcatctgatgcaccagcagtgggaaaagatttaactcaagcggcagaaaatattccacccgcatttcataatgcaccgcgtcaaggcgaattacccgcattgaactatgtaaatcagcctccaatggttccacatagtgtggcaaactatcaagtgacaaaaaatgtaaatcaatgtttaaattgccacagcccagaaaattctcgtttgagcggtgcaactcgaatcagcccaactcactttatggatcgtgatggaaaagtaggttcaagttcatcgccacgtcgttatttctgtttacaatgtcacgtttctcaagcaaacgtagatccgattgttccaaatgatttcaaaccgatgaaaggttacggaaactaatttaagaggtctatatgtctgagaaaaaaccaaatatcttaaagcgtttctggcaatggtttagaaaaccaagccgtatggcgataggtacaattattatcttatcggctattggcggtattctttcttgggttggttttaactatggtttagaaaaaaccaacactgaacagttctgtgcaagctgccatatgcaagatgcttatccagaatatttacatagcgtgcattatcaaactcgtactggtgtgggggcaagttgtccagattgtcacgtaccacacgaatttggtgcaaaaatgaaacgtaaaattattgcagctaaagaagtatatgcgcactatactggaaaagtggataccttagaaaaattcaatgcacatcgtttagaaatggctcaaaatgaatgggcgcgtatgaaagctaacgattctaaagaatgtcgtaattgccataatgtagatcgtatgaccttcaatgatcaacgttctgtggcggcacgtatgcaccaaaaaatgaaaactgaaggtaaaacttgtatcgactgtcacaaaggtattgcacaccaattacctgatatgagtggcgttgagtcaggcttcaaagacgagaagtgattttctaaaaataggctgaaaaaatatcgcacttttttcagtctattataaatttgggtagtttataaaaaaatctgcactttaattcgctgatttattcagcctttaaggtgcagattaattatattttctaaagtgcggttaatttttagattatttttagcctaagattttatctaactcttggctaacttcttccactttttgtgtaccgtctaaacggaaatattgagtattccccgctttcgcttctgcttggtaataatcaattaatgggctagtttgtttatgatatacggctaaacgatctaatacagtttctggtttatcgtctgcacgaataattaaatcttcgcctgttacatcatccttaccttccacttttggtggattataaacgatatggtaagaacgaccagacgcttggtgtacgcgacggccactcatacgttcaacaatcacttcgtctggcacatcaaattctaaaacaaagtcaattttaacacctgaatctttcagtgcatccgcttgtggaatagtacgagggaaaccatctaacaagaaaccatttgtgcagtcagcttgagcaatacgatcttttacaagggcaacggttaattcatctggcactaatttaccttcatccattaatgctttagcttgtttgccaagttcagtccccgctttgattgcagcacggaacatatcaccagttgaaatttgcgggataccaaatttgttcataataaattgtgcttgagtgcctttacctgcacccggtgcacctaaaagaataattttcataaaaaatctccattaatacaaaacgtgattaagatactgataaagcatagtgcggtcaaattttttataatttttaccgcacttttatactgagctggtcttattattttcttgcttcaaaggtgctacccaaaataaacaaagcatgccgggaatcgctaaaaataaacaaaaccaaaaatactgataataccccactgctcccacaacataaccagaaagtatacctaaaactttacttggcaaagctgaaaggcttgtaaaaagtgcaagctgtgttgcagtataaagaggattactctcacgcgccataaaagccacaaaagcagcggtaccaagtccaacgccgatatattctgctgcaatcacaacacctagtttccataactcggcagatgtaataacatcaaaatgtccaaaagcagccaaccaaataaacccaccaattgttaccatttgtacaagcccaaatagccacaatgcacgattaatacccagttttagcattatcataccaccagcaagcccagataaaatgcttgaccaaagtgcggtactttttacaacaatagcaatatcctctttgctaaatcccatgtcataaataaatttggtttgtaacgttgtggcaaaagaatccccgaacttatacaaaaacaaaaatagtaaaaaaccgatagcctgaatgacgcccttacgctggaaaaattcttgtaatggaatccaaaatgcttgatagaacggctgattagtttgctgcatgtctatttttggctctttggctaaaaatagtgtcatgaagatgcctgctaacatacaaagtgcggtccataaaaagacggtttcccaaggataaatcgccgccaaatatagcgataatccccctggaattaatcccgcaattcgataagcattaatatgaatagtgtttcctaaacctaattcatgatcactcaaaatttcacgacgatacgcatccaacacgatatcttgtgtagctgaaaaaaaggcgataagcaacgcaatatttgctactgtacccagttgtgtgagcggatcaaacaggctaatgatgtaaagtaaaatcaataatgccacttgtgaaagcaacatccagctacgacgacgccctaaaaaactcgggaaataacgatctaataatggtgcccacaaaaatttcaatccataaggcaacatcacacccgttactgcaccaataagctcaattgaaagatgtttatctgtcagccaaacaggcaacatttgcgacaatacaaataatggcaaaccagaattaaaacctgtgaaggcgcaaattaacatcttgcgcgtaaaaatttgagaagaaagggaatttgacataaagtgcggttaattttagttgtattttagaaatttcgcctttcaattaaaggatttttgtaaaaattaggggatttttaatcattcccctaatgtttagcattcttcttcctaaaaaagaaaaacaaatattagagaatattaatctctatacccttttggattatttttctgccagttccacgtgtcttgcatcattttttcaagaccacgttctgccacccaaccaagctcttttgccgctaaactaggatcagaatagcaagtggcaatatcgccagagcggcgttctacaagtttatatgcaattgtaatattgttggctttttcaaaggcttttaccatatctaatacggaataaccatggcccgtaccaaggttataaatatgtaagccagcgtcattttcatgacgttgaagcgcttttaaatgccccacagctaaatccactacatgaatataatcacgcacacctgttccatcatgagtgtcgtaatcactaccaaatacagaaagttgtgctaatttaccgatagcaacttggctaatataaggtaataaattatttggaataccatttggatcttcaccaatcaagccactttcatgcgccccaactggattaaaataacgcaagatagtcatgctaaattttggttccgcttttgctgtatcgcgtaaaatctgctcaaccatatatttagatgtaccataagggttggttgtaccgccgacttcacaatcctctgtaattggrataatttttggntcgccgtaaaccgttgcagatgagctaaatacaaagttccaaacacctgcttttttcatttcttgaattaatacaagggtgccagcgacattgttcatgtaatattctgtcggcttttgaacactttcccctacggcttttaaccctgcaaagtgaataaccgagttaatctcattttctgcaaaaattttttgtaacaaagcacgatctaaaatatcgccttcataaaactttgcttctttgcctgtaatttgttttacgcgctcaagggattttggcgatgaattgcaaagattatctaataccaccacctctttgccaacatttaataattctacaactgtgtgagaaccgatataaccagcgccacccgtcactaaaatggccataatgatttccttgttaattattgagactaaaaaattatatcactattttgtgtggtaagaatggtgattttcaataaaataaaaaacctgttgctaaaaagtattgttgtagcgagtgagataacctctcatatttagggctatgtccattagttgtgtgatataaggttatctaatcccattttcttgattttaaggcgtgttttatatcattaggtaaacgtaatatatcccagatcaaccgaaaaatcagattttggtaaattcttggtttggaatatataccaatttttttatatacaaacttcggcggaattaaaatatcttgtgtgtaatttttcttttcttcgagaataaaagtaattgggttattcagtggtgataaaggaaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctttttgatgatgaaatgcgtaaggattccctttttcttgataaaaatcaatacctgttaaataaagatctttataacccattacagttgccactgcacacatataaacgcctgatgtaattctcttattttcatataattcgttatattgtaaataggcatcaaaggcgggtagcttgtttaaataataatgtccaatatcaacttgtgttagtaatttttgtacatttttaattttctttaattctgaatctcctaaattgacaaaagatgataaaataatatcagcatattcatattcattatttttaattaattgcataaaagtatagtattgctcaaaaattgtagaacaattaaaaaatactttttttattttcttgccaagaaaataatgatcttcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattgattgattgattgattgattgattgattgattgattgattgattgattgattgattgacatattgtaccgttcattgaataaaatagaagttatccctnaaaaatnataaacattatatagatttatagaactttttactaaacgttgattataccttcctaaaantattatctaatatcagttgtacgatctccgttgtatcttagcaagagaaatttaaaaatgcttttcttgttccattcggatagaaacctaattgcttgttttttctaccaaacaagcgtaaacttaccaacagtttttagtcggggtgccgaaaggctgagatgatacccgtgaacctgaaacagttagcactgacgtaggaaactaatatgccaaaaaatccattttcttttcattccatttcttatcctttcttttttattacgcactccctttaatcattgaggcgagcaatggtgcgtattcaagatttgagtcttgcctttaatgggcaaacgttatttgagcatcttaatttaaccctgttgccgaacgaatgggtgagcttgttgggcagttcaggcgtgggaaaatcgacacttttgcgactactggcgggcattgaaacgcaaggcatggtgcaggggaaaatcctatttgaaccgaaagttcgcattgcgtggttgccacaaaaagagacactttatccgtggttgtcaattgtcgataacgtgcagttgcaagcggtcttatttgggcgaaaatctgtaaaaaccactgaaaaagctaaaatgttgcttgaaaaagtgggaatggcagcacattggcacaagccttgttcgcagctttcgggcgggcaaaaacagcgggttgccttggcacgcaccttaatgcaagaggtggatttgattttgcttgatgagcctttttccgctcttgatgccatcagtcgccatcaacttcaagatttagcctttgaactgctcgaagataaatcagtgctgctcgtgacccacgatccacaagaggcattacggctaagtcagcgtatttttgtgttgcgttcgcctgaaactcatcaaacagcattatcggcggtgattctgcccgaaggtaacgccccgcgtgagttgcatcaagccaatttatggacgttgcagcaacaattattgcaggaattagggggcgaacaatgaaaattcgcctacttaaaccgcttttaattgttggcgtgttgttgatgatctggcaaatggtcgcaaccttgggcagcttcccacactacatttttccctcaccgcaagctgtaaggcagcagttattcacacacgctgaactgctttggcagcatacgcaagtcacgttgttagaaatctgcttagggctgttgttaggctttctatttgggttgatttcggcgttgttgctctcattttctcgtcaaatttctgccgtcttattgccgattttggtcatttcgcaagcgattcccgtgtttgctattgcgccgttgttggtgttgtggtttggctatggaatggcatccaaaattgtgatgtcggtgctgattatctacttccccgtcacggcagcttgttatgatggactacgcaacaccccacaagcgtggctcgatttggcgaaaacctttaacatttcccccttgcgtttattgcttaaagtgcgattacctgcggctttgcctgcttttgcttcgggcttgcgaattgccgtttcggtcgccccgattggtgcggtggtgggcgaatgggtaggttcatctgaaggcttggggtatttgatgattcacgccaatgcccgaatgcaagtcgatttaatgtttgccgccttactgattttagtgtcaatttcactctgtttatatttcagcattgattggctattacaccgttttatttggtctgtttaacttttcattaaaggagaaaaaatgaagacaatcatccgttatttcagctttgtaatggggctaatgctcactcttcctagctttgcaaaagagaaaatcagcataatgctagattggtatgtaaaccccgatcatgcagccatcattgtggctcaacaaaaaggcttttttgaaaaaaataacttggaggttgaaattatcgaacctgctgatcctgcattaccgccgaaattagctgcggcagaaaaagttgatttagccgtgagttatcagcctcagctttatcaacaagtggcagaaggcttgcctttagtgcgagtgggttcactgatttcaaatccattaaatagcgtagtggtactaaaaaagagcaatttgaaaagccttgctgatttaaaaggtaaaaaagtggggtattctgtcagcggttttgaagatggattacttgatacaatgcttcattctattggtttaagcaataaagatgtggaattagtgaatgtaaattggtcgctttcgccctctcttttaactggacaagtggatgctgtgattggtgcatttcgtaattttgaactcaatcagcttgctttagaaaagcaagaaggtatcgcattcttccctgaacaatatggcgtgcctgcttatgatgagttgattttagttgctaataaaaacagcgtaacagataaaaaaacatcggcatttttgaccgcacttgaacaagccacaagctatctacaagctcaccccaatgaagcgtggcaagcctttgtcagctataaaccaaacgaactcaacacgccattaaaccaactggcgtggaaagacacgctcccctttttagccaataaacctcgccaattagacgctaaacgttatcaacaaatggcagaatttatgcaacaaaaaggcttaattccaaaagccttagccttgaaagaatatgcggtagaaattgaataaggaaaaaagatgattgaacaactcattcaacaagctcagccttattggcaacaatatattgaacacgaatttgtgcaacagctcgcaaaaggtacgctaccaaaagcttgttttcagcattatttgaagcaggattatctctatctttttcattacagccgagcctttgccttaggtgtattcaaggcaaaaaatttcgctgaaatggaaacacctcgtaaaaccttagagattctttgccaagaaattcaactacatttaaattattgccgtgagtggggaattagtgagcaagagatttttaccacccaagagagtgccgcttgcattgcttatactcgctatttgcttgattgcggcatgacgggcagtttggctgagctttatgcagctgtaaccccttgtgctttgggttacgctcaagttgctcgttacattactcagcattatcctcgcttaccgaacaatccttatcaaacgtggattgacacctatgcgagtgaggaatttcaacaagccgcccaagaaaccgttgattttcttaccgcactttgcaaaccactaaacccaagccagcttgctgagattcaacagattttcaccaccgcaactagaatggaaattgcgttttggcaaatggggttggatttggcttaggcttagattggcgattagacgaataactttatttatctccaaacggataaatttattgcgattttctacctcctctttgagaaaagaggggtagaaaaattatcttattctaatcttgctataagctaatgctataacaaaaaatgcggcttgcagaagaataatacaagcacctgttgaggcatcaaaatgatagctcaatattacgccaattaagcttgatgcaatggaacttgcaatagcaacccataacattttatcaaaagatttagtaagagtaagtgcggtaattcctggtgcaattaacattgccaccaccaaaataacacctaccacttgcatcgtgcttacaatggttaaagcaagtagaattaataaaccataatgtaaaattttaggagaaagtcctgcaacacgggcgtgacttggatcaaaacaataaagcagaaagtctttacgtttaaagacaatcagacaaaaaattatcgcagaaatgaccgcactttgaataagttcttgatgacttacacccaacacattaccaaacaaaatatgggttaaatgctcttctgtttgaattttggtaaacataacaagaccaatggcaaacattccagaaaatacaatgcccattgcggtatcttcttttatacggctattttctttcaaatatcccacaccaagcgaacaaaaaatacccgagaaaaatgcaccaatggctaaaggaattcctgccaaataagcaagtacaataccaggtaatacagcgtgagaaattgcatcacccattaatgaccaacctttcaagactaaatagcaagaaagtaacgcacagataatcgaaacaatcaatgcggtcaataaggcattttgcataaactcaaattgtagcggttctaaaagccaatcaaacattttctaccgcctttttattacgagttaataagccatattttggtgaaaataagaaagcgactaaaaacaataatgtttgcaatgtcacaatcacaccgcctgtggcaccatctaaataatagctaatataaacaccaacaaaacttgtcaccgcccctaaaataatagcgatgattgacaaggttttgaatttatctgtgagtaaatatgctgtcgcacctggggtaacgaccatcgcaatcactaaaatcgcgcctacagtttgcaaggcagcaaccacacaagcactcaataatgtgaaaaataaaattttataaaataatggagaaagaccgactgtaatcgcttgtgtttcatcaaaaaaaatcagcagtaaatccttccaaaataataaaagcaatactaaacaaacaccgatgataattgccacttgataaatatcttcatcagcaatgcctaaaatattacctaaaatgatattttgcacatttactgcggttggatttaaagaaacgattaacaaacctaatgcaaagaaagtactgaaaataaacccgataacggcatcttctttcagtttagaaatagatttaatccaaagaatggaaagtgcggctaaaattccggcaaaaaatgcaccaagtgcataaggcaacgcaaaagcataggcaattgcaacaccgggtacgacagaatgggaaagtgcatcaccaattagagaccagcctttaagcattaaatatgaagacaaaaaagcacaaatgccacccactgcggtactcaaaatcatcgccttgagcatataatcataggaaaaaggttcaagcaataaatctaacattacctaatccctcttatttttaactgcacttttataagggcaatcttcaaaatgacaattttgtgttgttggcgcaggtggatcttgcttagtttcgccatagaatacaacggctttttcatcatctgttaagacggtaacagaacgtttatcttcatcattatgtaaattttcgcccaataatttaatatgacgcaacaccccaccaaatacaatttccaaattatgttggttaaaggtgtcttctgtttttcctgcggcgatgactgtgcgattaatcatgaccacttgatcacaaaaatcaggaacagaacctaagttatgggttgaaacaagaatcagatgaccttcttctcgaagctgttgaagaagatcaacaatggcattttcagttttcacatcaacgccagtgaaaggttcatccaataaaataattggactttgttgtgctaaagcgcgggccaaaaacacgcgttttttctgcccgccagataactcgccaatttgacgatgcgcaagatgctcaatatttactcgctgcatcgcctcttgaactttttgtttatcaatcgctttggggatacgaagaaaattcatatacccataacgtcccatcatcacgacatcatacactgacaccggaaattgccagtccacttcttctgattgtggcacataagcaaccaaattacgtttcagtgcttgggaaattggcaaatcacaaagtttaatttcgccttgttgtggctttacaagccccattatgcttttaaataatgtggacttgccacttccattcacgccaactaacgcacaaatagttccactattgagtgagaacgtcatattgtgaatagcagtatgaccattgttgtaacgaacagttacatcattaacccaaattgatgtcgagaaagagtccattattttccgaatcctttaacaatagttgatacagtgacgttaagcaaatcaatataagttggcacagggccgtttttcgcagaaagtgaatcaacgtacaatacgccaccgtattttgcaccactttctttagctacttgttgtgcaggtttggctgaaattgtactttcactaaacacaactggaatattgtttttacgaactaaatcaatcactttacgcacttgttgtggtgtgccttgttgttcagcattgattggccataaataaccttcttttaagttgtaatctttcgccaaataactgaaagcaccttcacttgttacaagccagcgttgcgcttctggaatttgtgctaattttgcacgaagcggttcatcaagttgtttaattttttgagcatagtcagcggcatttttttcatacacagctgcattttgtggatcgtatttcactaacgcattcttaatattttcaatataaattaaagcattagatggcgacatccaagcgtgtggattaggcgcatctttatacgggccttcataaatagataatggttgaataccttctgttactaccacagcaggtttatctttaacattttggaagaaacgctcaaaccaacgttctaaatttaagccgttccataaaattaaatcagcagattgtgcttttacaatgtcttttggcgttggttcatattcgtgaatttcagcacctggtttggtaatagattccactgttgccgcattgcctgccacattttgcgcaatatcttgaatcacggtgaaggtggtaacaactttgaattttgcattagcttgcattgcaaataaaccaagtgcaagtgcggtcataattttgaatgaatttcgcataagatgtccttatttaaaaaagatagattgaatgcctgaataattgttcaatagctcaacaattattcatcggagataatagtactactttttatattgttttggaatgggaatgattatcaaaataatagatttatttataattatttcgtacaaaatgtattgaatgtatgaaaaaagaacaaaacattttggttagtattaagttcagcaatagtcttggctgcttgtgatgataaacctaaaatgacagaacaaaccaaaacaactgaccaagaaaaagtcactgtagaacagcctgctcatcagctaaaaaatgcgagataaaacaaactgttatctcgcatttttatgtttatgaacattattttgataatttctgaattagcgtattaaatcccacttcatcatagccatcttcatattgggcttctcctgctacatcacgaattgttcttccatttaatgccgtgcagccgaatttttctaatttgcttttagtaaaactagaacgatacgctgaggaagtgttatttaaactaattacgccaatagttgcatttttgcatcggtgtttattaatgaaaacgagattataaccagattcttgaatgtagcctgttttattcactgccgcatcaaaaatttcatcacgcactaacttattggtatttttaatataaagtttttgtttccctgcttggatataagttgcactaagattagataaacgtttaatgtccgatttatttaatgaatatttggcgagcttaactaaatccattgggctggaaatattatagctagataatcctgaactatcgtgaaaacgagtagaatacataccaagttgatgggctttttcgttcattttcttaataaattggcgacgacttattcccgctgcacgagaaagcgcgtgggcggcatagttatcagaatggacaagcattgctttcaataattcgttacaagaaataggaatatttttaggtaattttgttccagtgcctttaattcgatccgtatcctcttttgtgattgcgattcgacaattaggatttttattattctctaaaaatacattagccgtcattaattttgttacagaggcaataggctgaatactatcagacgcgtggctttccaacactcgattatgggtaaaatcatacacaacataagactgtgccaacgcaaaagaaggacacaaagataaaataaataaagcttttttaaacattattggtcaccttaaaaaataggctgatattttaccgcactttttccgctgtaattgaaaatatttgcgatctagatcgcaaaaaagtgcggtaagattttctatcgtttttcaattccgctagattatgcggtgacaaatctgtacaatcgccgttcattttttaattgcgaatttttcgttgtgagtttttgataaaaacacctgcacaatgctatcgccacaatgtgtaataacgaggctaaaatgtcagaattattgtctgtgcaatcagatgcacccgctaaaaaaattaatctaatggatttaacgcgccaacaaatgcgcgaattttttaaagaactcggcgaaaaaccatttcgagcagatcagttagttaaatggatttatcattttggcgaagataatttcgacaatatgacaaacattaataaaaaattacgtgaaaaacttaaggcggttgcagaaattaaagccccagaagttgccgttgagcagcgttcagccgatggcacgataaaatgggcaatgcaagtgggcgagcagcaagttgaaactgtgtatattcccgaagcagatcgcgcgacgctttgtgtatcttcccaagttggctgtgccttagcttgtaccttctgttcaaccgcacaacaaggctttaaccgcaatttaacggtttcagaaattatcggtcaagtatggcgagcctctaaaattattggcaactttggcgtaactggcgttagacccattacaaatgtggtaatgatgggaatgggcgaacccttattgaatgttgctaatgttgttcctgcaatggaaattatgttagatgattttgcctacggtttatcaaaacgtcgtgtaaccttatcgacttctggtgttgtgccagcattagataatttgagcaaaatgatcgatgtggctttggctatttcattacatgccccaaacgatgaattacgtgatgaaattgtgccaatcaacaaaaaatacaatatcaaaacattgattgactcggtaaatcgttatttaaatgtatcaaatgcaaatcatggcaaagtgacgattgaatatgtgatgctcgatcatgtaaatgatggcgtagaacacgctcatcaacttgcagaagtattaaaaaatacgccttgtaaaattaatttaattccgtggaatccgttcccagaagcaccttatgcaaaaagctcgaatacgcgtatcgatcgcttccaaaaaaccttaatggaatatgattttaccgtgattatccgtaaaacccgtggagatgatattgacgcagcctgtgggcaattagcgggagatgttatcgatcgtactaaacgtacggcaatgaaacgccaatttggacaaaatattggggtgacagaagttaattaatattctaggtatgtgaattaatcaagttcacatacccctatgttttcatacaaattaaagcatattaagtatttcttcctgcccaattaaaaggaggaaaaatgaaaacaataagtaaacaactaagtgcggttattttccctttcattttttctgcctgcgtttcacaatctgcatctagcttaaatcatcaaactgccgctaaagcgcgtgtggaactcgctttgagctatcttcagcaaaataatcctcaactggctaaaatcaatttagacaaagcacttcaacacgataaaaattactatctcgtgcattcagcacttgcacattattatcaacaacaagggcaaatagaaaatgcctttcgtgaatatgaaatagccgtaaaccttaatcataaacaaggcgatgtgcataataattttggtacgtttctatgtagtcaaaagaaatttgaacaagctcagcaacaatttgaattagcacttaattcgccgaattattatcatcaagcagatacatttgaaaatatcgtgctttgtgcttattccgcgcaaaaaatggatatttatcagcaaacattagaaaaattacgtcaaatcgatggaaaacgtgcggaaaaattcaatagcctaaaataaagcattgccaaatcaagtattggactttaaaatttagcctccatttaccgcctaattatttgattaaatttatgaatccaactactgagcaagtgctttcccctggtgagatttttcgtcaaacacgcgaagccttaaatctttctcttgaagatgtcgctaaagaaatcacgctacgcccttctatattagagcaacttgaaaataatgaatttattcaaaaatctacccctgcaatctttgtaaaaggttatgtgcgtagctatgcaaagttcttacgtttgccagattctgtgtgggaaaatattgtttttgctgaaacagaaaaaaatgatttagggaaaaatgcacgttcaacccgtgccgttaatcaatattcctctcacaatcgttggatcgggcgtttaaccgcaatagtattcatgattgtaattggtatgactgggctttggtggtggcagagttatcaacaaaatactcaagaacgcgatgatttagtgcaaagctatgttgcctctaccgaaaacaatcagcccgccaccgctcttgtgacaacagaagaaagtaataaaactgtaccagaaacagcagcaccagtctcacaaccagtagaaataacaaataatctgttaccagaaatagcacaagaaaatagcgtttcacaacccaaaaacgatgaaaaatcagtttcagaaattcaaagtgcggtcgaaaatccaagtatttctccaacattacctatagcaaaaggcgatttagtgattgaaatactaacaaatagcagttggattagtgtaaaagataacgctcgccacgtattagcacaaaaagaatataaacaaggcgaaatattaacctttaatggcaatgaattttcattaattgtaggcgcgccaagcaatgtgcgcatcacttacaaaggcgagaattatcctctgaaagtggatggtcgtgtagcaaaattcaaactttcacaaccttagggaaaaataatgtcagcttttcagccaactattaagcgtcgtgaatcgacaaaaatttatgtgggaaatgtaccaattggtggggatgcgcctattgccgtgcaatcaatgacaaatactcgcaccactgatgtggaagcgacagttgctcaaattaaatcattagaacgtgttggtgcagatattgttcgtgtatctgttccaacaatggatgctgcggaagcatttaaacaaattaaacaacaagtgaatgttccgctcgtagcagatattcatttcgactatcgtatcgcgttaaaagtcgcagaatatggagtggattgtttacgtatcaatcctggcaacattggtcgtgaagatcgcgtccgtgccgttgttgattgtgcgcgagacaaaaatattccgattcgtattggtgtaaatgcaggctctttagaaaaagatttgcaagaaaaatatggcgaaccaacgccagaagccttgttagaatccgcattgcgtcatgtagaaattctagatcgtcttaacttcgatcagtttaaagtgagcgtaaaagcctccgatgtattcttagcggttgaatcttatcgtttactggctaaagcaattaaacagcctttacatttaggcattacagaagcaggtggcgcacgcgctggtgcagtaaaatctgcagtgggtttaggaatgttattagctgagggcattggcgatacactacgcgtctctttggcggcagatcctgtagaggaaatcaaagtcggttttgatattttgaaatctttacggattcgttcaagaggaattaactttattgcttgcccaacctgttctcgccaagaatttgatgtaatcggtacagtaaatgcgctagaacaacgccttgaagatattattacaccaatggatgtatctattatcggttgtgtagtgaatggtcctggcgaggcactcgtctccgatctcggcgtaacgggcggtaacaaaaaaagcggttattatcttgacggagaacgccaaaaagagcgttttgataacgaagatatagtgaaccaattagaagcaaaaattcgtgcgaaagtcgcacgacaagatccaaaaaacagaattatttaaggaaagctcgtggcaaaaacaattcaagcaattcgtggtatgaacgattgtgccccaacagaatctccattatggcaatggattgaagcacaagtacgcaatgtattaaatagttatggctattcggaagtgcgtatgccaattgtagaaagtacgccattgtttgcgcgtgcaatcggcgaagtaactgatgttgtctcaaaagaaatgtacacattttgggataacgatgaacaattaaccttacgccctgaaggcacagcaggttgtgtgcgagcagccattgaacacggttggatctataataatgaacaacgcttatggtatatcgggccaatgttccgtcatgaacgtccacaaaaagggcgttaccgtcaattccatcaagtaggtgttgaggtattcggtattgcaaatccagaaatcgatgccgaattaatcatgcttacctatcgtttatggaaagcattaggtatcgatcaacatgttacacttcaacttaactcaattggttctttagaagctcgagcaaattatcgttcagctttagttggattcttagaaaaccatcaagatttaatgagcgatgaagaaaaagagcgtttagtaagaaatccgcttcgtattttggatacaaaaaatccagaattacaaaaagtattagataacgcgcctaaattgcttgattatttagatgatgaaagccgtacgcattttgaacaattatgttcattattagatgcagtgggtattcaatatgaaattaatcctaaactcgttcgtggcttagattattacaacaaaactgtatttgaatgggtaacctctgctcttggcgcacaaggtaccgtgtgtggcggcggtcgttatgacggtttagtggaacaacttggcggacacgcaacgccaagtatcggatttgcgatgggattagagcgtttagtcttgttggtgcaagaagttaatccaaatgttcctgcgaaaagtgcggtggatatttatgttgtttatcaaggcgaaggcgcaacattagccgcttttgaattagcggaaaaagtacgctcggaattaccgcacttaaataccatgttgcactgctctagcggtaattttaaaaaacaatttaaacgtgcagataaatctggtgcaacattggcattagttatcggcgaaagcgaagtacaaaataaacaagtcgttgttaaacacttacaaggtggcacagatcagcaaaccttagatttagtgaatataatcgactatcttcaaactcaattttaatttaaaaggggaaaacatggcttattccattgaagaagaacaagagattaaccagttaaaagactggtggaaagagaatggcaaaacaattattgtcgcttttatcttaggtgtgggtggtatgtttggatggcgttattggcaaactcaccaagcagaacaaatcgctcaagcttctgcacaatacgatactttaattaattctgtgcaacaagacgaacaggctaaaaaagcaaatatagaacaatttgtgcaagcgaatagcaaaactgcatacgctgtatttgctttgttagatgaagcgaaaaaagccactgaaaaacaagatttttcagcagcagaagcaaatttaaaccaagcattaacccaatctcaagatgaagtattaacatctattgttgcattacgtctaagtgcggtgcaattccaattaggccaattagataatgctttaagcacattaaaccaagtgaaaggcgaaagttttaatgctcgcaaagcgattttaacgggcgatatccaagttgcaaaaggagataaagttgcggcgaaaaacagctttgagcaagcacaacaaagtggtagccaattagaacaacaaatggcaaaaatgaaattaaacaatctttaaaaaataatacccgcatcaaagtgcgggtattttttcaatcaaatttctgattattcaaattcatctaaccattttaataaaatagcctcaagaattgattcatttgatttattcggatcatcgtcaaaattctcaagttcacaaatccatttatgtaaatcagtaaaacgaactgtttttggatctaaatctggattacgatcgtaaagttcttctgcaattaattgggcgtctgtccatttcattagtgagccgcctcatttgcgtgattaaggttatattttggaatttctaccacaagatcttcatttcccacgacgcattgacaagataaacggctatccatttctaatccccaagccttatctagcatatcttcttcttgatcactcgtttcatttaaagaatcaaacccctcacgaacaatcacgtggcaagttgtacaagcacaagaaccatcacaagcgtgatgaatttctactcccgcattgtgagcaacttctaataagttatctcctgttgcagcatcaacgaccataccttcaggacaaaaatcttcattaggtaaaaaaatcacttttggcataatactttcctcaaaattatttaatatctgactgcagttttacggattttcaatgtctgacagatttttacctgtcaaagctttattaattgatgcattcattcggcgagcagcaaattcttgggtagcagtgtctaaggctttaattccttgcgcaattgcatcgcgatctgaaccttgttttacatccattaattgttttaacacagtttcaatatgatgaaattcatctgtgctaagcaattcagccccatctgcttgtagcgcaacaatcacgctttcaataacacgatctgcttccacacgctgctctgccaattcacgtgcttgtaaatcttcttgtgcattatcaaaagaagatttaatcattgcggttacttcttcatcagttaatccataagatggtttaatttgtattgaagcctgtacttttgtcgatttttccatcgctgtaacgcttaataaaccatctgcatccacttgataagtcactctaatatgggctgcccccgccgccattggtggaatacctcgtagagtaaagcgtcctaaagaacgacaatcatcgactagctctcgttcaccttgtagcacatgaacagtcattgccgtttgcccatctttaaaagtagtaaactcttgcgcacgagccacaggaattgttgtattacgtggaataattttttccactaatccgcccatcgtctcaatgcctaaggaaagcgggacaacatcaagtaataacatatcagaatcagttttattcccgactaaaatatctgcttgaattgcagcaccaagtgccacaactttatcaggatcgattgaggttaatggtgttttaccaaaaaactctccaacttgttctcttacataaggcacgcgagttgaaccaccaaccattactacggcttgtacttcttcggattctacattggcatctttcaatgcccgacgacaagttagcaatgaacgttttacaagcggataaattaattcattgaattgttcccgcgaaatctctactgaaaaatcttgccaagaaataaccgcacttttttcattagtcaaggtaattttagcttggttggcaagggttattagctcacgctgttgatttgctgtttgtggttttagcttagtttgttctattacccaatctgcaattaaatgatcaaaatcatctccacctaatgcagtatctccccccgttgctaaaacttcaaagataccttttgataagcgtaaaattgaaatatcaaatgtgccaccgcctaaatcataaaccgcaataatgccttcttgcccactatccaatccataagcaagtgcagctgcagtaggttcattcaataaacgtaatacatttagcccagctaaacgcgcagcatctttagtactttgtcgttgagcatcatcaaaataagctggaaccgtaatcacaaccccagaaagctcacctccaaggcgttgttctgcaatgtgatttaagcgcgataaaatatctgaagacacttcaattggacttttagccccctgtgccgtaataattaaaggtaatccattttcactcgccacaaattcataaggcaaactagaataacgagactgaacatcagaaaggctgcgaccaattaagcgttttactgaaatcaccgtatttttgggatcaagtgaggcttgttcaaaggcttctaaaccaactttcttctcttcaacgccataatgaacaactgacggcacaagactgcgttcttgttcatcattaagaatcacggattgcccactacgcacggatgcaaccaaagaattggttgttcccaaatcaatcccaacggctaaacgatgttgatgcggtgccgcagcttgtcctggttctgcaatttgtaataatgccatatgctatttttctactagttatgcgacggaatacgccaaatcaaatttatttttttctgcaaagtttgcttggtaatgggtttcaatattgacttcctgtttttgacgttcatcaattgctatttttctgtcttggtttaaatcaggcgtaaatacaaaaacttggttaccatctaattgttttacatcatcttgccaatttttccaaaatagcccttgataaaaggcctctacatcgccattcaatacccaagctaaaaattctgtgtaagtaaaatttaaattatgccaagtaagatcttttgatgaatagtaataaatttttccaatattattgcctaacgaaccaccatttaacgcaaaataaccaccaatcacatcatctgcaactaataaatattttggtttttcgcctgactcactaaaagatttactgaaattccaatccatcaagccacgcggtaatttaaaacttccagaacctaaaatacgtaaccaaccataatgaattaaaattccacctgtttcatagattactgcacccattggcgaggatgttggcatttgcatagtaaaaagctcacgctccgcactggattgatcttttttaattacttcacaatgattgcgagcgttatcaatccattgggaaagggttatccaagcagaatgttctgggctagtgagctgttcaagagtttgcatagtgttatttattcacatctcgtaggggcaaattacatttgcccccacatttaatctaattcaaaaattcgttcttccacacgttcaatttcttcagaaagtttatgggtaaaacgtaatttatcacagtattgagatgctctcgcccattgttgagatttcaaactctcaaaaagtgcggtcaataatgattgagtttcttgtttaatttctttagcaaaagcatttaatgctctttcatcttgctggcgttcaacttcttctaattgttcgcgccattgtaattgttgcattaaaaacgccacatcttgcgtgcttttttgttcaagatctaactgctcaccagtattaagagcaatgatcgcttcagctcgcaaaattgggtcttttaacgtttttaaggcatcattcacttcggtagatttttgcatcgcaacacgttgatctaaagcattacttgagacaaaattatctggatgtagggccttttgtaattttaaataacgtgcatttagtactttttcatccagctgaaaatcaactggcaaatcaaaaatttgaaaaggattgaacatcagattattaccttaaacgtggaaactttcgccacaaccacaagattcttttacatttggattattatatttaaagccttcatttaggccttcttttacataatccagctcaatgccattgagataaacgagactttttggatcgacaataatattaacaccgtactgctcaaaaacttgatcttcggaatttaaaacatctacaaactcaagtacataagctaagccagaacaacctgatgttttcacacctaaacgtaatccaatacctttaccacgattatccaaaaaggctttcactcgctgcgctgctttttctgttaatgtaatacccatctatcccccaacaccgctaaaaatgcggtcaaaattgaccgcactttttcacatgattagccttgttttgctttataatcagcaattgctgctttaattgcatcttctgctaaaatagagcaatgcactttcactggcggtaattctaattcttcagcaatttggctatttttaattgctccagcttcttctaaagatttaccttttacccactcagtaattaatgaactagatgcaatcgcagaaccacagccgtaagttttgaattttgcatcttcaataatgccattatcatctactttgatttgtagttgcataacatcaccacaagctggcgcaccaaccattccagtaccaacattgctatcttttttatccaatgatcccacattacgtggattttcataatgatcaattactttttcgctataagccattttaactttccttttttcaattctagtgaatgccattgtcagataatggcaactaaatattagtgagctgaccactcaatggtatttaaatcaataccttctttaaacatatcccataatggcgataatgcacgaagtttttctaccgcacccttcattaaattaattgtgtaatcaatttcttcttcagtagtataacgacctaatgtgaaacgaattgaactgtgcgccaattcatcatttaagccaagtgcgcgcaatacataagatggctctaagctagcagatgtacaagcagaaccagaagagacagcaatatcgcgcaacgccatcattaaggattccccctcaacatagttaaaactaatatttaaattgctatctaaacgatgttccattgaaccatttacataagtttcttcaatatcttttaagccattatataaacgatcacgaagtgcttttaaacgcggcatttctgatgccatttcttcttttgcaattcgatatgcctctcccattcctacgatttgatgaacaggtaatgtacctgaacgcataccacgttcgtgaccaccaccatgaataatcgcctctaaacgtacacgaggtttacgacgaacatacaatgcgccaacaccttttggcccgtaaagtttatggctagacatcgacattaaatcaacagctaattcttccaaattaatttcaactttaccaacactttgagttgcatccacatggaaaattgttttatttgcacgacaaagttcgccaatagctttaatatcttgtaacacaccaatttcattattagcgtgcataattgaagctaaaattgtatctggacgaagcgcagctttgaatttttctaaatcaattaaaccatcagcttctggagacaaataagtgacttcaaaaccttctcgttctaattgacggcaagtatctaacactgctttatgttcagttttacaggtaataatgtgtttacctttagtttgatagaaatgcgccgcacctttaatagcgaggttatcggattctgtcgcaccagaagtaaagacaatttcacgagaatctgcgccaatgagatcagcgatttgattacgcgcaatatcaacagcttcttctgcttgccaaccaaatttatgtgagcgagaggctggattaccaaatgtgccatcgatggttagaaacgccatcatttttttcgcaacacgttcatcgactggacaggtcgctgcgtagtctaaataaataggtaatttcattttcactcctaaattatgctaaatataaccgcacttttttattaaaaaatatactgcttatcttttttattgattaactaataaattattaaaatcacgatgagattgacgttttacattacgcttatttaccagctctgctaacgtaatctcatttaaaaaactttcaatacgtaaacttaaatcttcccaaagttcgtgagttaaacattccacaccatttttacaattttcacgccccagacatttcgttacgtgaatattttcatttactgccgcaataatcattcctacagaaatttgttcacttggtagccctaactgataaccacctcctggcccgcgaacacttttgactaaaccgtctttacgtaatttagcaaaaagttgctctaaataagataaggaaatatgttggcgttcagaaatatccgcaaggcttacaggcccgccatctgcatttaaagcaatatctaaaacggctgtaactgcataacgacctttcgatgtaagtttcataaagaatccctaaaaattaattgcgcaatacttacatatctgactaatttagtcaattatcctcttttgttaaatcaattcgtttttcaaccgcacttagcatgccatttaaaatatttaattcgtttttctctaattttgcacgatagtataaacgctttaatttacgcataactccttgattttgaataaatccaagagactgatatatacgttctgtgtagtcaaaaaaataagctaactgatctgttgttggatagtttttctctattaaagaaagtgaatttttcttattattttgaactaagaaagccakacgcaattcataacttaccagctgcacagccattgctaaatttaaagaagaataatcaggattcgctggaatattcaagtgataatgacatttcagcagttcttcattggttaatccaatacgctcacgaccaaacacaatagctatcttgcctttatacgctacaactttctccgcgcattctcgaggctcgatcaatgtattttgtaaatgacgtaagcgagcacttgttccaattaccaaagggcaatcatcgacggcttcatcaaaactatcgacaaccctagcattttttacaatattttctgcgccagctgaaagggcataagattgttcatcaacagatttaggtgaaacaagacaaagctgggtcaatcccatcgttttcattgctctagccgcagaaccaatattaccactgtgcgaagtttcaattaaaacaatacgaatattttccaacataatgatacccgactaaaatttaagggtattctaccacaataaccgctaaaaatagtcaagaatttaagctaattaaagaaatttaaaatattagggatgaataataaaaatggtgggttgtgagagactagaactctcgactgacggattaagagtccgctactctaccaactgagctaacaacccaactggacaactaaatcagagagtggtgggtcgtgaaggattcgaaccttcgaccaacggattaaaagtccgctgctctaccgactgagctaacgaccccactgtattaaatggatttatgataacgcatttgctctagaaccgaaagaataaattcattctttcaagctaattggttaaattacaaacgatgaaaacaaaacagganccaataaaaaatggatcctgtttttcaagtattagaaatactaagaattagtacgctaacactgcacgacggtttttagaatatgcagcttcatcatgacctaatactgcaggtttttcttcaccgtaagatactgtgcctaatttaccagcatcaacacctttaccagctaaataacctttaactgcatctgcacgacgttggcctaatgcgatgttgtattctggtgtaccacgttcatcagtgttaccttctactaatactttagcagctggcgttgcatttaaatatgcagcgtgcgcgtctaagatttgaacgtattcaccagtaatgtcatatttatcaaaaccgaaataaacggtattgtaacgttgttgaagatcagcaacagagtaaccgccaaaagtttgagcagcaccattgcctgcagcatcgttgttagatgaactacaagctgctaatgcagctacagaacctgcaactaataatgatttaacaaatttgttcattagatttctcctaaatgagttttttatttagttaagtatggagaccaagctggaaatttaacttgaccatcacttcctggaaggctcgccttaaagcgaccatctgcggaaaccaattgtagcacctttcctaagccctgtgtagaactataaataatcataattccatttggagagaggcttgggctttcgcctagaaaagatgtactaagtacctctgaaacgcccgttgtgagatcttgtttaactacattattgttaccattaatcatcacaagtgtttttccatctgcactaatttgtgcgctaccgcgaccacccactgctgttgcactaccaccgcttgcatccattcgataaacttgtggcgaaccacttctatcggatgtaaataaaattgaatttccgtctggcgaccacgctggttcagtattattacccgcaccactcgtcaattgagtaggtgtaccgccatttgctcccataacgtaaatattcagaacaccatcacgagaagaagcaaaagctaaacgagaaccatctggcgaaaaggctggtgcgccattatgcccttgaaaagatgccactactttacgtgcgccagaatttaaatcctgtacaacaagttgtgattttttattttcaaacgatacataagccaaacgctggccgtctggagaccaagctggagacataattggttgggcactacgattgacgataaattgattatagccatcataatctgctacacgaacttcataaggttgcgaaccgccatttttttgcacaacataagcgatacgagttctaaaggcaccacggatcgcagttaatttttcaaaaacttcatcgctcacagtatgcgcgccatagcgtaaccatttatttgttactgtatagctattttgcattaatacagtccctggcgtacctgatgcaccaaccgtatcaattaattgataagtaatactataaccattacccgatggaaccacttgcccaattacaattgcgtcaattccaatattcgaccaagcctcaggatttacctctgcagctgaagttgggcgttgaggcatttgagaaaccgcaataggattaaacttaccactgttacgtaaatcatctgcaacaattttactaatatcttctggtgcagaaccaacaaatggcacgacagcaataggacgcgcaccatcaaccccttcatcaatgacaatgcgtacttcatcgccagcgaatgcattgcttccaacagcaagtacaatcgcgaatacgctcactaaacgttttaataatttcattttgttacctttaaaatttaacaataaatttttctaaagaattatcgaatatcaaagtcaataattggtgatttatatttttcataaatttcatctgatggcgcagctggaacttttttcgttctagccaccgcacttaatgcagctgaacaaatatcatcagagcctgaaattttttgataccccaagattgtgccatctcgacctaattgaattttaatacgacaaacctttcctgcaaaatttggatcttttaagaaacgacgttgaatctctttcttaattacacctgcgtattgatccccaaccttaccaccatcgccagagccaagtgcagcaccgctaccttgagttccacctttatttgtgtttccccctttagatgcactaccgccaccaatatctccgccatttaagaaatcatctaggcttgcttgatctgctttacgtttcgcttccgtagcagctttagcttctgcatcagcttttgcttttgcctctgctgccgctttcgcttttgcctccgcttcagcctttgctttagcttcagcaacggcttttgccttagcttcggcttctagtttcgccttagcttccgcctcttgttttgctttttgagcagcaatttctgctgctttcgctttagcctcttcttcagcttgttttgccgcggcagctaaacgtttagcctctgcatctgcttttaattttgcagcttcagccgcttgtttagccttagcctcttcagcttgcttctgtttttccaacgcttcttgacgagcttgctcttgttgtttttttatttcttgctgacgttgctgttcttgctgacgttttaactcttcttgtcgttgaacttcttgttgatgcttaatctcttcttgattaggctcaggtggtttttcttccacaacaggttctgggcgtttttgtttatccgcttgcccttttttttgttgttgaatacgcccccattcctgagcagccgtaccagtatcaacaatcactgcccctattacatctccttcaccttctccaccacccataatttcaacagtgtgataaagtgagcttaaaatcaataagccaaacaagataaagtgcaaaaggatagaaatagcaaaagcattgattcctttcttttgtcgattattttgcacgtgttacctacttagctaaatgggatttgtcattaaacctacagatttaatgcctgcaagatgaagtaaattcaatgccttaatcacttcttcataaggtacttctttagctccgcctactaaaaatagcgtattattatccttatcaaattcctgtctagataattgagtaaccatttcttctgttaaaccttcttgacgttctccgccaatagaaatcgcatattttccaatgcctgccacttcaagaatgacgggtactttatcttcattagaaacctcttggctttgcacagaatcaggcaattcaacttgaacgctttgactaataataggggcggttgccataaaaattaacactaaaactaaaagcacatctaaaaaaggcacaatattaatttcagatttaattgctttacgctgacgacgagccatatattcctctaaaattttaacttatttttaccgcactttttcttcaaagtgcggtcaattttccctatattttagtgaggggctttaccaaaggcttgacggtgtaaaatcgtcgtaaattcatcaataaaattaccgtaatcttgttcaatggcattcactcgtaagcttaaacggttataagccattactgcaggaattgcggcaaataaaccaatcgcagtggcaatcaaggcctcagcgatacctggcgctaccatctgtaacgttgcttgttttgcaccacttaatgccataaaagcgtgcatgataccccaaacagtgccgaataaaccaatataagggctaacagatgccactgtggctaaaaatggaactcggttttccaaactttcaatctcacggttcatcgcaagattcatcgcgcgcattgtgcctttaataatcgcttcaggtgcatctggatttacttgttttaaacgtgaaaattctttaaatcccacgcaaaaaatttgttcgctgcccgttaatccatcgcgacgattagatagcccttcataaagtttatttaaatcttctcctgaccagaaacgatcttcaaacgtacgcgcttcttttaaggcattcgttaaaatacgactacgttgaatgataattgcccaagatatgattgagaaagaaatcaaaatcacaattaccagttgcacaacaatacttgcttttagaaaaagatctaaaaaattcaattctgcagtcattgcatactccgaaaaattattttaagtgatgaaacgccgctttaacttctttgggaaacgccactggtttcatcttgcctagatcaacacaggctaccttaacagtagcctttgataacatcagggtgttgcgcatcagtctctgttcaaaaaggattgtagccccttttacttctgaaacctctgtttccaccataagtaaatcatccaattttgctgccacgcaataatcaatggcgagcgttttgacaacaaatgcgagttgttgttcctctagtaaggtttgttgcgtaaaatttaatgtacgcaaatattctgttcttgctcgttcaaaaaaatgcaaatagcgagcgtgatacactacgccacctgcatcagtatcttcataatacacacgaacaggaaaagaaaagccattatccaacatattctcacccaattggtcgcaataaaccgtgtattctagaaccagtttttgggataagcaagctatctatgaaaaactcaataagattttattcattttaaaacatctaaaatttttaccgcacttttagcctgactagcaaaagataaggtaatgacaaatcatttttaacctttctcattgagtaaaatctattcaaaacataaccgttctttaaaaatagcctctatgtaatcttaagccaccagtatttttattcttgatatttagcgtttctatgcgacaatctttgcggttatttactttaaaaatatgttttactagatggattacgaaaatcaaattgccaatattttctcactaaatggcgaattaagccaaaatatcaaaggttttcgtcctcgagctgaacaacttgaaatggcatatgctgtaggtaaagcaattcaaaataaatcttcccttgttattgaagctggaacgggtacaggaaaaacctttgcatatctcgcacctgctttagtttttggtaaaaaaaccattatttctacaggatctaaaaatcttcaagatcagctttttaatcgagatcttccagctattaaaaaagcccttaatttcacgggaaaaattgcgttgctaaaaggtcgggcaaactatctttgtttagagcgtttagatcaagtgattgctcaaggtgtgcttggagataagtctgttttagctgaattaagtaaagtacgaaaatggaataatagtactaaaacaggcgatttcacagaatgtatcgagcttgcagaagatagcccaattattcctcaactgacgagtacagcggaaagttgtttaggcaccgattgccctaattattcagaatgttatgtagcaagtgcgcgtaaaaaagcattaaatgcggatttggttgtagttaatcatcatttattttttgctgatatggctgtgaaagaaagtggttttggcgaacttattccaaatgcagaagtgattatttttgacgaagctcatcagttacccgatattgccagtcaatattttggtcaatctttaacatcacgccagctttttgatttgtgtaaggatattaatattgtttaccgcacagaacttaaagatatgcagcagcttggcacaacatctgataccttactgaaagtggtacaagattttcgtttattactgggtaatgggagtaatgttcgaggaaattggcgtgagctttacacgcaaagtgcggtgaaaaaagcctttgaattattacaagagaaaatagattttttatctgaagtaattaaattagcacttggtcgttcccaaactttagacagtatttttgagcgtgttgagtccattaaaatccaactcaaacgtttatctgaaacaaatattgtgggttattgttattggtatgaaggaaatggtcgccagtttggtttacatattacgccattgacagtagctgataaatttggtgctcagctcgaagcgaaagaagccgcttggatattcacatctgcgacattagaagtggggggaacttttaatcatttctgccaacgtttaggcattgaaaatgcgacacaaaaaattttatatagtccctttaattatcctgaacaatctttgctttgtgtgcctcgatatttgccgaataccaatcaaatgaatacattaaattcactaggcgaaatattattacccgtgattgaagcaaacaaagggcgttgttttgttctttgcacttcctattcaatgatgcgtggtttagctgaatatttccgtgaaaaaagtcatctttcgattttattacaaggcgaaacctcaaaaggcaaattactcgaacaatttataaaagaaacgcatagcgttttggtggcaacttctagcttttgggaaggtgtagatgtgcgaggcgatgcactttctttagtgattattgataaacttccttttactgcgccagatgagcctttgttgaaagctcgcattgaggattgtcgtttacaaggtggcgatccattcaatgatattcaaattcctgaagcggtaattaccttgaaacaaggcgttggacgtttaattcgtgatgttacagatcgtggcgttgtgattatttgtgataatcgattagtgatgcgcaattatggcgaaacttttttgaaaagtttacctaactcaagtcgtacccgtgatctcaacaaagtgatacaattcttacaaaataagtaaacgagaataagaatgcaaaatttaactttattggcgttggacacctctactgaagcctgttctgtcgctttattgtatcgtggtgagaaaacacatattaatgaacttgcccaacgcacacacactaaacgaattttacctatgatcgatgaaattttggcaaattcgggtttaggtttaaatcaagttgatgctttagcttttgggcgtgggcctggtagttttactggtgttcgtgttggtgctgggattgcacaaggtttagcgtttggtgcggatttgcctgtcattccaatttcaaatttaaccgcaatggctcaggcagcatttgaattacatcaagcagaaaatgttgttgccgcgattgatgcgagaatgaatgaagtctatttttctcaagtagtgagagaaaaagtgcggtcagattttggggaattttttcaatggcgagaaatcattagcgaacaagtttgttctccagaacaagcgattaaccagcttcaaaatgataacgcatttagagtcggaacaggctgggctgcttattctcaatttactgaaaaaaatctaactggctcagatatagcattgcctaatgccttatatatgttagaacttgcgcaggtagaatacttgcaaaaacacacaatttcagctttagaaattgaaccgatttatttgcgcaacgaagttacttggaaaaaattaccagggcgtgaataagtttaaataactggaggatagaaaatgaaaggaaaaatcaccttattttttaccgcactttgtttcggattaacgggctgtattgcaccaccaaaagggttagaaaaagagcgattctcaattaattcctatcgcgagatttcccctcaggatttgacctgtcattgtaaaacagttcgacttggaggaaaaattgtcaatactaccgttttagcaaatcaaacaaaaattgaagtgttaagtttacccgtatcatcaatttcagctaaaccatttgttgaattgcaatccgatggtcgctttatcgtgtatttcaacggttttgttgagcctgaaaatttaaaagaacgttatattactgtaggtggtcaattagctggaacagagaaaggcaaaatagaacaagctgattatacttatcctgttgttcaagcggataaataccgtatttggacactcagtaccacctatgattatccaacagatgattgggatgaagacgatgattggggattttttagatggagacatcgcctttggtatgttcagcctgaaattcactattatttgaattaaatgataaaatcttaaagattttccaacaaattaggataaaaaatggaaaaaatttggtttcaaaattatccaaaaggttctgaaaaatttctagatacctcaaaatatgaatctattttggatatgttcgacaaagcagtgcgcgaacatccagatcgccccgcttacattaatatggggcaagtacttactttccgtaaattagaagagcgcagtcgtgcatttgccgcatatttgcaaaatgaatttaaacttcaacgtggagatcgcgtggcattgatgatgccaaatttattgcaatatcctatcgcactttttggtattttgcgtgctggcttaattgcagtaaatgtcaatcctctttacacaccgagagaattagagctccagttgcaagatagtggtgcggtagcgattgtcgtggtatcaaattttgcttctaccttggaaaaagtcgttttcaataccaatgttaaacacgttattcttacccgaatgggcgatcaactttcttttggtaaacgtactttagtcaattttgtcgtaaaatatgtgaaaaaactggtgccgaaatataaattaccgcacgcagtgacgttccgagaagtattgagtattggtaaatatcgccaatatgttcgtccagaaatatcgcgtgaggatttagcctttttacaatacactggcggtacaactggcgtggcgaaaggtgcaatgctaacgcacggaaatattataaccaatgtcttccaagcaaaatggattgcagagccatttattggcgatcattctcgcactcgttcagctattttagccttgcctctttatcacgtatttgccttaacggtaaactgcttattatttttagagttaggtgtcacggcgatcttaatcaccaatccgagagatattgaaggatttgtgaaagaattgaaaaaatatcgttttgaagcaatcactggtgtgaataccttatttaatgcgttgttaaataatgaaaatttcaaagaagttgatttttctgcgttgaaactttctgtgggtggcggtatggctattcaacaatcagtggcaacacgttggcacgaattgacgggctgtaacatcattgaaggttatggaatgacggaatgttcgccattaatcgccgcttgtccgattaatgttgtgaaacataatggcactattggtgtgccagtgccaaatacagatataaaaatcattaaagatgatggctctgatgcaaaaattggcgaagctggcgaattatgggtgaaaggcgatcaagtaatgcgaggttattggcaacgaccagaagcaaccagtgaagtgttaaaagatggttggatggcaactggcgatattgtcattatggatgaatcatatagcttacgcattgtagatcgtaaaaaagatataattttggtttctggctttaatgtctatccaaatgaaattgaagatgtcgttatgctgaattacaaagtgtctgaggctgtggcaattggtgttcctcacgcagtttctggcgaaacgataaaaatctttgtggtgaaaaaggacgatagtttaactcgtgatgaacttcgcaaccattgtcgtcaatatctcacaggctataaagtgccaaaagaaattgagttccgagacgaactaccaaaaactaatgttggcaagattttacgtcgggttttacgcgatgaagagatcgcaaaacgtccaaaacattaatgtcaaaatgggatagcaatatcccatttttgttcttttcaaataaaaaaatcactatgataaaagaatgtcaaaatccaccgcactttagggtcgttacggataatactgcgctattagaagtttgtaatttagcccaacagaaaagtgcggtcgccttagatacagaatttatgcgtgtttccacttattttcccaagttgggattaatccagctttatgatggagagcacgtctctttaattgatcctttagcgattacggatttttcgccttttgttgcattgttagccaatcctaaggtattaaaaatcttacattcttgtagtgaagatttattggttttcttacaagaatttgatcagcttccacgcccaatgattgatacgcaaattatggcacgatttcttgggcttggcacatcagcaggattggcaaaattagcacaacaatatttaaatgtagaaatcgataaaggcgcaactcgcaccaattggatcaaacgccccctttctgatattcaacttcaatatgccgcaggcgatgtttggtatttgttgccactttatcatattcttgaaaaagagttagcgaaaacaccttgggaacaagcagtaagagatgattgcgaacttgttcttgctaaaacgcataaattacaagagcgagattcagaaaaagcgtatttagatattccaaatgcttggaaattaaatccattagaattgtctcgtttaagagttttggcacagtggcgacaaaacgtggcaatagaacgtgatttagcactttcttatattgtgaaatcagaacatctttggaaagtggcaaagaataatccacgtaatacatctgaaatgttagaaatgggattaactgaaaatgaagtgcgtgtacgtggtaaggaaattctacaattactttctcaagcaagacgtatttcgtctaatgactatccaaaatctattgaacgtatttctgaagatcctcgttataaaaaaacaattcgattattacaagaaaaagtgaatagcttaacaccagaaggtttaacccctgaaatcgttgcaagtaaacgcactttggaagaattgattaaatgggtttggaaatatgattgttctcaagataaacgaccagagttgctgattggctggcgaaaacctattggtgaaaagttagtcgatgcacttaagtagatataaaaaagcgttgagtaaatagctcaacgcttttcgtttctactcgtagagttttttcacttgttcaggtgtcatcactcgttggtatttactaaattcttttgccatatagtaagcaccaaaatttgttaagtgatcttgatccccatacaagtattttccttctgccataacgctatcttttggtaaatactgttgagcatctacccaataaacattaggaatatctttgactaaatcatgaataattttgttactcgcatcaatatcgcccattctacgaattggttctaaatatttttcaaggccatattttcccagtaaatatccacgaataggcgatctgctaatagaactgttatttgcaaagatataaactgattttgatttagccagtaattttacagtttcaacaaagcgagttttgaagttatcaataaaggaagcctgagcgttaaatcggggaacaggttgtcctcccattcttaaatcataaaatccagaaataaaaatagctttatatttaggtgaattaatctcatcaagtaacccttgacactcaggtgttattttattgtttttatccactaaaacaaaacaatccttcccatcagttatgcttaaaatagttgacttccatccttcttgcttaccaagatattttaaaaaataagtaagatgaccagcatgagaatcccctattgttaaaactgtagttgggaagttattctctaaattaacagataaaacatcttgttcaatatgttctttttcttttctaatctgttttctttcataagtgttataaccaataataaaaagagatggaattagataaagatagataaatgcctgtttaaagtttaattttgattttcttataggttgctcaattaaataataacttgtgatagaaaaaataatagttaatataacaacaattaaaactgtaatgccttgaatctgcttgctgccagtaatgtaataagcaaacgcaataaaaatccaatgatataaataangagaataagganattttnccaataaacactattgctttattaggataancattatttaacggatgttattttgtgatgtggtatgaataattaatgctgtaaaaatacaaggaagaattaaagtaatacctggaataaatgcaatattattattcattaaaaataagcaggaaaataataataatgtacttaaaatagccagaatattatttacttgcttactcaattganccttgtttgaaagattatgataaattgccaacaaagatcctacaagtaattcaggaaatcttaggttagagagataataaatattaggctggtgcaatacttctttgtaaaagttagctgaaacaaaagatgtcgcaagtaaaataaaaaacaaaattagcgttataataaataatactttaacttctctaaattttttataagctaaaatgaggattagtggaaaaataagatagtattgtccttctacggctaatgaccaaatatgtaatacagggttttcatttgcacttaaatcaaaataaccttgtgttaatcctagatagaaattagataggaatgcaatagctaattcaatggttttccttaatttattgaaatcattataaataaaantagcagacgcaatgaaagacactaatgccattactgtaataaaagcaggataaattcgtttaattcgtcgagtataaaattgtttaagcgaaaaagaattctgttgaatttctgtgataataatacccgtaatcaaaaatccagaaataacaaagaaaatatccaccccaagaaaaccaccagataaccagttttcattaagatgataaataatgactgaaataacagcaattgcgcgtagtccatcaatttctggacgtatttaatagatgacataatattccttttataaaatatcgaccgcaccttgatttatgcgtcaaaagtgcggtgattttttatgtgtttttatacgttgaatcggaaatgcattacatcgccatcttgtacgatataatctttgccttctaaacgccatttacctgcttcttttgcaccgttttcaccgttgaattggataaagtcttcataagcgataacttctgctcggataaagcctttttcaaagtcagtgtggattacagctgctgcttttggtgcggttgcgccgactgaaactgtccaagctcgtacttcttttacgccagcagtgaaataagtttgaagatttaaaagtgcgtaaccagcacgaattactcggttcaatcctggttcttcaatgcctaaatcttgtaaaaactcgactttttcttcatcatcaagttctgcaatttcagattcaatcgccgcacatactggaacaactaccgccccttcttttgcagcaatttcacgaacgcgatctaaatatgggttattttcaaagccatcttcatttacgtttgcgatatacattgttggttttaacgttaagaagttgtaactcttgattgcttgcaattcttctttatctaacccaacagaacgaatcattcctgcattttccagcacaggaaggattttttccataacggaaagttcaaatttagcttctttatcgccaccttttgcacgtttttgtaaacgttggattgctcgttcacaactgtctaagtctgctaaggctaattcagtgttgatagtgtcaatatcatcaagtgggtcaattttccctgcaacgtgtacaatgtcatcgttttcaaaacaacgcactacgtgaccaattgcatcggtttcacgaatatttgctaagaatttattacccaagccttcgcctttgctagcacctgcaactaagcctgcgatgtccacgaattccatcgtagtaggtaatatgcgttcaggcttaacgatttctgccaatgcgtctaaacgtggatctggcattggcacgacacccgtatttggttcgatagtacagaatggatagtttgcggcttcaatgccagctttagtgagtgcgttaaaaagagtagatttgccgacatttggcaatcccacaataccacatttgaatcccataatttttcccttattttgagtaaaacggttgtaaaactaaccgcacttttaaattttaaaactgtttaaacgattggtcgctttgaccattccatctctgaaaatcatttctacacaatcagtggcttcatctagcactttttcaagtgcatcgcgatctgctggagatggtttatttaagacataacctgccactaaatcacgatggccaggatgcccaatgccaatacgtaaacggtagaaattattgttattgcctaattgagccacaatatcttttaagccgttatgcccaccatgtccaccgccttgtttgagtttcgcagtgcctggtggtaaatctaattcatcatgaatcactaaaatttcttcaggtttaatacggtaaaaacttgccaatgcgccaactgctttaccgcttaaattcataaaagttgttggcactaaaaggcgtacttcttttccattcactaaagtgcgggcagtttttccgaagaatttactttctggatttagtgaaacgttaaaacgacgagccaagcgttcaataagccattcgcctgcattgtggcgtgtatctgtatatttatcgccagggttgcctaaaccaacaataagttttatttctgacatttttatttgatgatgtaaaaaatagtggcgtattgtagcgaaaaagccttaaattctcaatctataaggcggaaacaaagaggtaatttattgcgcgtgatttatcattaaaagtcaccgcacttttccgttataatggctaaaattttttaacaaagaagtaaaaatgaatcagattaacattgaaatcgcttatgcttttcccgaacgttattatttgaaatcttttcaagttgatgaaggaattaccgtgcaaacggcgattacgcaatcagggattttaagccaatttccagagattgatttgagcacaaataaaattgggattttcagtcgtccaataaaattgactgatgtattaaaagagggcgatcgtattgaaatttatcgtccattacttgcagatccgaaagaaattcgccgtaagcgtgcagcagagcaagctgcagccaaagacaaagaaaaaggagcttaaaaatgaccgcactttcatctgttgatttttgtttacctgaacatatcacgccagaaatttttctacgtgattattggcagaaaaagccacttgtgattcggaacggtttgcctgaaatcgttgggcagtttgagccacaagatattattgagctcgcgcaaaatgaagatgtgacagctcgtttagtgaagacattttctgatgatgattggaaagttttttttagtcctttgagcgaaaaggatttccaaaaattgccagaaaaatggtcggtgttagttcaaaatttggagcaatggtcgcctgaattaggacaactttggaacaaatttggctttattcctcaatggcaacgtgacgacattatggtgtcttacgcaccgaaaggaggttctgtcggtaagcattatgatgaatatgatgtatttttagtgcaaggctatggtcatcgtcgttggcaagtgggtaaatggtgtgatgcaagcactgaatttaaacccaatcaatcgatccgaatttttgacgatatgggcgaattagtcattgatgaagtgatgaatcctggggatattttgtatattccagcccgtatggcgcattatggcgtggctgaagatgattgtttaaccttttcttttggcttgcgttatccaaatttaagcaatttgattgatggcataagcaaaggtttttgtcatcaagatcctgatttgaatttaagcgagtttgatttaccgctacgtttaagccagtctgaacaacgtacaggtaaacttgcagatgaaaatattcaagcgatgaaacagcttttattagataaattggctcattcagaagcttttgatacgttatttaaacaagcagtggcgagtgcggtaagttctcgtcgttatgagttattggtttctgatgaaatgtgcgatcctgatgaagtgcggtcaattttagaagaagatggcgcattcctttctcaagacaacaattgtaaattgctttataccgaaaatccgctgcgaatttatgcgaatggcgagtggttagatgaacttaatataattgagagcgaagtattgaaacgtttatctgatggcgaaagtttagattgggcgtttttatctgatttagccaataaaacagaagatcctgaaacctcaatggatttgttgttggattccatttgtaactgggttgatgatgggtgggcgttaattgaataatatgtcagacaatatttattccgtctctcaactgaattctgccgcgcgtcagatgcttgagggtaatttttgccaaatttggctaacgggggaaatttccaattttacccaacctgtgtctggacattggtatttaacgctgaaagatgaaaatgcacaggtgcgttgtgcaatgtttcgtatgaaaaatttgcgtgtagcttttcgtccacaaaatggaatgcaagtgcttgtgcgtgccaatgtgagtttatatgagcctcgcggcgattatcagcttattattgattctatgcacccagcaggcgagggattattgcaacagcaatttgaagcgttaaaaatgaagttggctgcggaaggattgtttgctcaaaatcttaagaaaactctaccgcactttagtaaagcagtggggattataacttcttctacaggtgcggcattgcaagatattttgcatattctggcacgccgtgatccaagtttaaaagtcgtcatttatcccactgcggttcaaggcaaagaggcaactgcagaaattgtgcaaatgattgaacttgctaatgcgcgacaagaagtagatgtattaattgtggggcgtggtggtggttcattagaagatctttggtgttttaatgaagaagaagtggcgcgagcgatttttcgttcaaccttacctattatcagtgcggtgggacacgaaacagatgtgacgattgccgatttcgttgcagatcttcgtgcgccaaccccctctgctgcggctgagttagttagtcgtaatcaagatgaattattgcaacaacttcgccatcaacagcaacgtttagatatggcatttgatcgtttatttacgcgaaaaagccagcgtttgaaacagcttgccttacgattgcaaaatcaacatccacagaatcagctacgtgctcaacaagcgaaaaatgaacagcttacacatcgcttgcaacttgcaatattgcgtcagtttgaaaatacacaacaaaaattcaccgcactttctgttcgtttaaaacaaaatccattgccatatcgcatacaacgttatcaacaaggcttagagcagttaaaagtgcggttaaatttttgcgtaaatcgccaagtgacggaacgtcaaaataaactggcaacattatgcggaaaactggatggcttaagcccattaaaagtcttggcgagaggttattccattgcggaaaatccgcaaggtaaagccattgttagcgtgaaagatgtcaatcaaggggacttcattacaactcaagtggctgatggaaaaattgtgagtaaggttttgtaagatgcttattttgtaaaaatggagtgaaatactgtttcacttacttctaaaaaagaatgctatgactgttgaataaataatcatggcattttgtttttttgtgactcacttcaaactctcaacaaaaagtggaaaccttctattttttttgtagtcttttaagcgtatgattttgcgtgcagttttggagaaaacagatgtcagaaattcaacattttagccaacaagatatagaaatattgggcgaacaaactttgtatgaaggttttttcacgcttaaacgaatccaatttaaacataaactttttgctgggggacaaagtggcgtcgtaacccgagaattactgattaaaggtgccgcctcagcggttatcgcttatgatccaaaagaagattcggtgattttagtcgaacaagttcgtattggcgcggcttatcatcctgaatctcatcgttcgccttggttacttgaactcattgcaggtatggtggaaaaaggcgaaaagccagaagacgttgctttgcgtgagagtgaagaagaagcagggattcaagtcaaaaatttaacacattgtttaagtgtgtgggatagcccaggtggcatagtggagcggattcatttatttgcaggcgaagtggatagcgcacaagcaaaaggcattcacggtttggctgaagaaaatgaagacattaaagtgcacgtagtaaaacgtgaacaggcgtatcaatggatgtgcgaggggaaaattgataatggcattgcagtgattggattgcagtggcttcaattaaattatgctcagttacaacaaagttggaaacgtagctagggggcattaatgaaaaatacgtttgtttatcaggcggaaaagcctgttataaagttattacaaattaccgatccccatttatttaaagatgaaagtgcggaattattgggggtaaatacacaagcaagttttgctcaagtattaaaggaaattcagcaagaaaataacgaatttratgtaattcttgctacaggcgaccttgtgcaggatagtagcgatgaaggttacattcgttttgtagaaatgatgaaacctttcaataaacctgtgttttggattccaggaaatcacgactttcagcctaaaatggcagaatttttaaatcagccacccatgaacgcagcaaaacatcttctattgggcgagcattggcaagccttattgttggatagccaagtttacggtgtaccacatgggcaactaagccagcatcaactcgatttattaaaagaaaccttaggaaaaaatcctgaacgctataccttggttgtattacaccatcatttattaccaactaattccgcgtggcttgatcaacataaccttcgtaattctcacgaattggcagaagtgcttgcgccttttaccaatgtgaaagctattttatatgggcatattcatcaagaagtaaacagtgaatggaatggttatcaagtgatggcaacgccagcgacttgtattcaatttaaacctgattgccagtatttttctcttgataccttacagcctggttggcgtgaaattgagctacattcagacggttcaattcgtacggaagtaaagcgtattcagcaagcggaatttttcccgaatatgcaagaagaagggtattaaattttgtggacgttttaaaaatcactttcatagtaagcatttttaaaacgtccactattctaacccaataaaagtgcggtcgagtttcagattatttttaacgattcgccagttcaaaaatcatcgcttctgcttggcaactaaaagtgaaagaagcatttaattgaacgccgttttcaactgccacgatttcgcttttaatttcgcaaggatcgctttctgtattgcgcgctttctttgttaatcgttcaagcactgcattggcatcagcttcagtgctataaaattgatgtacttctacgctacagtcagagccatcaataatagtgcctacatcaacacagctacaagttaaggattcttctgctttgcattttacggtcattttctttnccttatatgaatatttttgtgcattttatcatttttctttttccccataaatgacaaaaattcaacaaaacaatccattaaatgcaaaaagctcctgctaactagtcgtagctctaataaaaataaggaatagagttgcactcaatagattcgggctttataattgcccagatttttatttataacaaagggttccaaatgaaaaaatttaatcaatctctattagcaacagcaatgttgttggctgcaggtggtgcaaatgcggcggctttccaattggcggaagtttctacttctgggcttggtcgtgcctatgcaggtgaagcggcgattgcagataatgcttctgtcgtggcaactaacccagctttgatgagtttatttaaaacggcacagttttccacgggtggcgtttatgttgattctagaattaatatgaatggtgatgtaacttctcatgctacaataataacatcaagtagtggaattaaagcaatagagggcggctcagcttcagcgcgtaatgttgttcctggtgcttttgtgccaaatctttatttcgttgcaccagtgaatgataaattcgcgctgggtgcaggaatgaatgtcaatttcggtctaaaaagtgaatatgacgatagttatgatgctggtatatttggtggaaaaactgacttgagtgctatcaacttaaatttaagtggtgcttatcgagtaacagaaggcttgagcctaggtttaggggtaaatgcagtttatgctaaagcccaagttgaacggaatgctggtattattgcggatagtgttaaggataaccaagtaaaaactgcactcacagtacagcaagaaccactcaaatttcttgataagtatttgccctctaaagacacatctgttgtgtcattacaagatagagcagcttggggctttggctggaatgcaggtgtaatgtatcaatttaatgaagctaacagaattggtttagcctatcattctaaagtggacattgattttnctgaccgcactgccactagtgtagaagcaaatgttatcaaggcaggtaaaaaaggtgatttaacccttacattgccagattacttagaactttctggtttccatcaattaactgacaaacttgctgtgcattatagttataaatatacccattggagtcgtttaacaaaattaaacgctagcttcgaagatggtaaaaaagcttttgataaagaattacaatacagtaataactctcgtgttgcattaggggcaagttataatcttgatgaaaaattgaccttacgtgcgggtattgcttacgatcaggctgcatctcgtcatcagcgtagtgctgcaattccagataccgatcgcacttggtatagtttaggggcaacctataaattcacgccgaatttatctgttgatcttggctatgcttacttaaaaggcaaaaaagttcactttaaagaagtaaaaacaataggtgacgaacgttcacttacattgaatacaactgcaaattatacttctcaagcacatgcaaatctttacggtttaaacttaaattatagtttctaatccgttaaaaaatttagcataataaagcacacttccacaccaagtgtgcttttctttttataaaacaaggcgaaaaatgaccgcactttattacacttattacccctcgccagtcggacggcttttgattttatctgacggcgagagcattacacatattgattttgaaaaagagcaatatgcgcctaatccaaaatggcacaagcaagatgaattgcctgtttttcaaaaagtgcggttagcttttgaacgatattttaatggcgaagttgagtgtttttcaaacattcccttaaaaccagaaggcaccgcatttcaacaagccatttggcaagccttgcgagaaattgattatggcgagctttcaacttatggagagctggcgttacggattaataatcctaaagctgttcgtgccgtgggaggcgcggtagggagtaatccgattagtattattattccttgtcaccgcattttaggcaaagatcgtactttaactggttttggtggtggcttagaggcaaaacgttttttattgcagttagagaaaattccctatattgataaaggcactgaaaacacgaagcctcgcttttttaagaaatatcacgaatgattccacaaacccttgaacaattactttcccaagcgcaatcaatcgctggcttaacttttggggagttagctgatgaactgcatattcctgtcccgattgatttaaaacgtgataaaggctgggtggggatgttattagagcgcgctttaggcgcaacggcagggagtaaagctgaacaggatttttctcatttaggtgttgaacttaaaacattgccgattaatgcggagggttatcctcttgaaaccacctttgtgagccttgccccgttggtacaaaattcaggggttaaatgggaaaattcccacgttcgtcataaactttcttgtgtactttggatgcccattgaaggcagccgccatattccattacgtgaacgccatatcggcgcgccaattttctggaagccaaccgctgagcaagaacgtcaattaaaacaagattgggaagaattgatggatttaattgtacttggcaaattagatcaaattaccgctcgaattggtgaagttatgcaacttcgcccaaagggtgcaaatagtcgcgctgtgacaaaaggcataggaaaaaatggcgaaattatagataccttgcctttaggtttttatctaagaaaagaattcaccgctcaaattctgaacgcatttttagaaacaaagtcgctttaacttgattttaaaacacgaaaaaaaccgaccgcactttttagctcgttgccataaaaaattaaggggattcgatttcgttcccaaggtggcacgcctaattcttgccagattttttttatatcttctcttgggcgtttcggataatgtttcactttgcccgaatagccaaaacgaatagaaataggcaagttcgttttttccagcgtaacagagtaatcctgccagtagaaaatcagattatgttcattttcttgaactgtgagattgcctaaatcatcgggtaaatttagcgtattttgttctaattttagggtgcatttggttagatcagaaaacggcttagttaaatataaactatcttgataacgtcgaataactttatttacaagctgaaattgaggatttgcctcttcttttgcaaaaatgacatcattaataagctgtgtaagctggcgtttacttggcatttcaagctggttttcggcaagccacatacgcaaaagtgcggtctgttttgcgagagaatattggcggaactggcacagtttaaattggtttttaatttgacaatgttctgtaaaaatttcgctcaataaatcattaattagctgttgttgctcaaaacaatgttgtgctgaacgttgcacggctaaatcaaaatgagcccagcgttcacgtaattctggcaaaatttcattgcgtaagaaattacgatcgtatcgattatcttcattactttcgtctgtaatccagttgagtttttctttttgcgcgtaattttctaactgggtgcgagtaaagcctaacaaagggcgtaaaattggcatgccgaataatacactttgttgttgcattgcgcctaagccttttagcccactgccacgttttagggctaagaaaaaggtttcagtttgatcgtttagatgatgcgctgtgaccagcatttcttgtgtttgaagatattttttgatggcttgatagcgtgcttcacgtgcgccagcctcaataccattagttttatctacttgtactcgctcaataatcaatggaatttgaaattgatcgcataagtcttgacaatgtttagcccaactgtcggcattggggcttaatccgtgatgaatatggattgctcgtattgataaaggcggtaagtgcggttgtttttgacaaagttttgcaaataaagaaagaagtacagtggaatctaaaccaccactcaaggcaataagaaatgcttgagcggtggctttttggagttgtttttcaatgtctgaaagtaaatccattaggcaactttttcagctttataattgctgcttggattaagaatttcaaaacgtgcagcaatcgtttgtaattcgtaagaacccagttcaaaggtggttttcattacgcctgccacttcattattcattgcttcaaaagcttcaacatcagattttccattgagcaaattcgctaagaatgtacctgcgattaaatcgcccacgcccactggttcaaagttgaattgataaagtggacggcttaaatgccaaacaccctctggggttgccataataatttcaaatgtatcaggatcgttgattttacccgcactgcctaaatgtttaacgagaactttcttcacgccttttgcaatcaacgcattcactgcttttaatacatcgtcaaaggtattaattgggaattcggttagctgacgcaattcgtgtaagtttggcgtcataatatccgccactggaatggctttttcaataagtgcttcgcgaacgccattggcaactacgcagatttttttcggatgtggcattacagggtcgcataaataaagcgcattgggattacgcagtttgatttgttctaaggcaaaaagaatttgatcgacttgttccgcagatcctaagtaacctgatagtaaggcatcacattcttgtagtttttcaatattatcaagtccagttacaatttctcggatttgttcttgtggaatgaccatacctgtccattttccgtattgtgtgtgattagaaaattgaacggtatttaatgcccatacatctacgcctaacaactgcattggaaaagtcgcggatttgttacctgcaaaaccatagactacgtgggattggatcgaaagtacgtttttcattatattttctcctttgttgtatatttagatcaaaaaagagcggtaaaaatcaccgctcttttagaatgttagttagcaataaccgtaagacattaaacgttcatagcgtctatttaataattcttctttgcttagttcatcgagttcagctaaatcttcttttaaacgaagttttaagttttcagctatttctagataactacgatgtgcaccacctaaaggttcttgcacaatgctgtcgatgagatttaattcttttaaacggcttgcggttaatcccattacttctgctgctgttgatgccttttccgcacttttccaaagaatagaagcgcagccttcaggcgagatcactgaataagtggaatactgcaacatattaactttatcgcccacgccaatagctaacgcaccgcccgaaccgccttcgccgataacggtacaaataacaggaacggtaagctgtgccatttcgcgtaagttgcgagcgatagcttccgcttgaccacgttcttctgcgccgataccaggataagctcctggtgtgtcaataaatgtgataattggcaatttaaaacgttcagccatttccattaaacgtaacgctttacgatagccttcaggtgctggcataccaaaattgcgttgtactttttcttttacagaacgacctttttgatgaccgataaccatcactggacgaccatctaaacgcgccaagccaccaacaatcgctttatcatcagcaaaagcgcgatcccctgcaagttcttcaaattccgtaaaaatatgttcgatataatctaatgtataggggcggtttggatgacgcgccatacgtgaaacttgccaagcatcgaggttggcaaaggtttttttagtgagttcgttacttttcttttgtaagcgtttgatttcatcagttaaatcaactttatcatctgatgctgctcgtaatgcttcaatttttgcttctaattcagcaatcggcaattcaaaatctaaatattcttggttcattttgttatcctaaaaagaccgtaaaaatcgaccgcactttatcaaggaattaaactgtggcgcaaatggttttcactggttgggcaagcttataatcgctctcttttaaagagcgataagacaaataaaaacgcggaacaaatcacaacagaaggcccagcagcagtatcataaaaggctgataagattagtccacctataatcgataacatactcataataatcgcccagcccaccatagattctggtgttcttgcaaagcgacgagcggttgccgcagggattattaataaggatgtgataattaatgcaccgacaaatttcatactcaaggcaatagtcaatgcggttaatatcattaaaataaaacgcatttttttgatattaataccttcaacttgcgcgagttctggcgatacggtggtggaaagtaaggattgccaaaagtaaattaatgttgaaagcacaattatcacgccaatgccgatataaattaaatccgtataattaatcgcgagtaaatccccaaataaataattcattaaatctacccgtacattccgtaataatcctactgtcacaaccccgagagataaacagctatgggcgataataccgagcaaggtatcaatagaaaattgcgtattgctttctaaccacaccattgcgatagcaagaattaaggtaagcaccacaatcgcaatgtaaggattgacttgtaagaaaatacctaatgctacaccgagcaaggcagaatgagaaagggtgtcgccaaaataagccattttacgccacaccacaaatacgccaagtggcgcggtaataagcgaaagcacaatgcctgttaaaagggcaggaaataaaatttcaaacattatttatccttattttgacaatgcactgctgatgaattacaaccgcacacatctccgtgtaaagtgtgatgatgattgtgatgatgggtataaaagccgacattttgtgcgatctgatttccccataaacgcataaatgttggatcatttgagagaacatcaggcgtacctgcacaacaaatatgttggttaatacacaatacttctttactatccgccatcacaatgtgtaaatcgtgtgataccatcaatacagcacaatttaatttttgttgggtctgatgaatgagctgataaagttctgcctgaccagtaatatctacgccttgagtgggttcatctagcacaagtaaatttggtttatttaaaattgcacgcgccaataatacgcgttgcatttcgccaccagatagtttttgcatattatttttgcgtaaatgtgaaattgaaagttgctcaagtgcggtggaaatttcttgtgttttaatgcctttttttagcgaaagaaatcgctcaaccgtaataggcaaactatgatccaaatggattttttgtggcacatagccaatgcgaacatttttactgtaaatgacctcgccagaagtgggcgtttgtagttttaataaggtttttaataacgtagatttgccaccaccatttggcccaacaatagtgataatagaattgggatagatatttaaattaatatcttgcagagcggttttttgtgcgaaaaccacattgatattttttaattgaatgagcggttgttggttttgctcgttgcgaatggctgtgatattcataaaatcgccgtgttttcaacaatggttggggaaaataacgcatttttatagaattctcaagattttctctcttatgtcgaatatttaagcgtttgaataatgctttttccataggaatgaattttctttataatctgtagtctgaatgctgaaaacttttttattttagggatgccagtgcaacacgtaaaattagctcgagatagacgaaaaaaacgcgcatatataaaagtaggcgtgttttttgttgctattttgcttattttgacaggcattttactgacaataaaaagcaaacctgaagaaaactccatattttccacctttgacagtggggaatatcacgagttaaatacatcgccaaatgaaaattccaccgcacttcaacctgatgaaaacgccacctcttatgatgatgagctacaagcaaaagatgacgaagttgatgaagtaaaactatcttcagatgatctcgatactttacctcaacacgcacaagacgcactcaatggtttattagacgcagccgatcaagccataagaattactgatcaatttagctatacggtaaccgaaggggatacgttaaaagatgttttagttttgtcaggtttagatgattcatcagtacaaccattgattgcgcttgatcccgaattagcccacttaaaagcaggtcagcaattttactggattttagataaaaatgataacttggaatatttaaattggctggtttctgaaaaagaagaacgtatttatgaacgtctcgaagatgggaaatttaaacgccaagttattgaaaagaaaagtatttggcgaaaagaagtattaaaaggcgagattcaaaattctttaaatagtagtttaagagaaaaaggtcttgatacgcgtcaaattagccaacttagtaacgccttacaatggcaagtgagtttgagaaaactaaaaaaaggaactcaatttgccattttagtttctcgtgaatatttaggcgataaacttactggtcaaggtaatgttgaggcgttacgtatttcatctggtggtaagaattattatgctgtgcaagctgcaaatggtcgttattataatcagcaaggagaaaccttaggcaaaggttttgctcgttatccattgcaacgccaagcacgcgtatcctccccttttaatccaaatcgtcgtcatccagtaacaggacgtattcgtccgcataaaggtgtggatttctccgtttctcaaggcacaccagttattgcaccagcagatggcacagttgaaaaagtcgcttatcaggctggcggtgcaggacgttatgttatgttacgtcacgggcgtgaatatcaaactgtttatatgcatttgagcaaatccctagtaaaagcagggcaaacagttaaaaaaggcgaacgtattgcactttctggtaacacggggatttctacggggccgcatttacattatgaatttcatattaacggtcgagcagtgaatcctcttactgttaaattacccggtactagcagtggtatgacttcagctgaacggaaacaattccttgttcgtgttcgtgaagcagaaagaatgttaaaaccttagcgatataaagtgcggtcaaaaatggtcgcatttttaccttatgtaaaataatatttacactttgttgtaaagaaattatcatagccatatcttaattatctccattccctgaatatgacgatttctaaatttaatcctcaaaaacctttcgagtgttttattgtacaaagtgaagcgatgaaaagtgcggtagaaaacgcgaaacgttttgctatgtttgatgcgcctttgttaattcaaggcgaaacggggagtggaaaagatttgttagcgaaagcctgccattatcagagtttgcgtcgcgataaaaaatttatcgcagtaaactgtgcgggtttgcctgatgaagatgcggaaagtgaaatgtttggtcgaaaagtcggagacagtgaaaccattggtttttttgaatacgctaataaagggacagttttactcgatggcattgccgaactttcattaagtttacaggctaaattattgcgttttttaacggatggatctttccgtcgagtaggcgaagaaaaagagcattatgcaaatgtgcgcgtgatttgcacatcacaggttccacttcatttgcttgttgagcaaggtaaagtacgtgctgatttgtttcatcgcttaaatgttctcactattaatgtgcctgcattacgagatcgcatggctgatattgagccactggcacaaggttttttacaggaaatcagtgaagaattaaaaattgcaaaaccaactttcgataaagattttcttctttatttgcagaaatatgattggaaagggaatgttcgagagctttataacactctttatcgcgcttgttcgttagtacaagataatcatttaactatcgaaagtttaaatcttgctctgccacaaagtgcggtgatttctttggatgaatttgaaaataaaaccttagatgaaattattggtttctatgaagcacaagtcctaaaattattttatgcagaatatccaagcacgagaaaattggctcaacgtttaggcgtctcccatactgccattgcgaataaattgaaacaatatggaattggaaagtagttttcacatttgagatgaaaaaaagtgcggttgaaatttcctgagaattttcaaccgcacttaataaatattgattacccattaatggtattgtgattactctgcttgagtttccacgttttcaactgcttctgttggagcagtatgatgattgttattgtgatgggaaactgaacgagcaggcacaacggttgaaattgcgtgtttatataccatttgattcacggtgttttttaataaaatcacgaattgatcgaatgattcaatttgaccttgaagtttgattccgtttacaaggtagattgatacaggaatgcgttcacgacgaagcgcatttaaataaggwtcttgtaaagattgtccttttgccattttgctatcctttgttgtcgttattatgaaatttgttgatagaaacgagttgtctccgtgtgtaagtgtagcaataaacagaaatattgtctatttgctttcccgcaacttttgcaaaattgctttcatttgatgatctagtgacgcattgaaacgtagtgtttcgccatttttagggtgttcaaaccgaattgaaaaagcgtgcaaaaacaaacgattcaatcctaattcattcatttgtttatcaaaatctttatcgccgtatttatcatctaatgcaataggatgcccagcatattgtgtatgcacacggatttgatgggttcgccctgtgactggtgaagccttcacaagcgtagcatttatatagcgttcttcaatgctgaagcgggtttcagatggttttccttgctcgctgacacgcacaatgcgctctccgctagataattcatttttcaaaagagaggcttgaataacttttatatgggattgccattgcccacgtactaacgctaaataatctttttgaacggttttgacgcgaagttgttcgtgcaaattgcgtaatgctgaacgttttttggcaattaataaaatgcctgatgtatcgcgatctaaacgatgaaccagttctaaaaagcgtgcttctgggcgtaatgctcgtaaggcttcaatcacaccaaaatttaaaccactcccgccatgcaccgcgattcctgagggtttatttaaaataatcaagcaatcatcttcaaacaaaatttggttttcaagtgcggcaactttattgagattttttgaaatcggcgcatcatttttttcagccacacgcactggcggaatgcgtacaacatcgcctgtttgcagtttatattctggtttaattctgcctttgtttactcgcacttcgcctttacgcacaatgcgataaattaaacttttgggtacacctttgagttttgctaataaataattatcaattcgttgcccactttcatcttcactaattgtcagcatttttacggatgaattaatgattttttcattttgttttgtcattttttttccttttgaaaatcgctgcaaatcatatcataaaggcactataaacgtaatatgaacgtcactctatgaacgcaaattcgccttgctaattaatcgttttctatggataatagagcctctttttgcgcctaagaatttgcgtaaaaaaggataagttttgttggtgaaaactcaatgcagcaattggcataagacattgataatcaacatttttcttaaaataaatcagccgtttgcaacgcgtgcggaatatcgcgttgttttatcaagcaaatatttatgcttaataacgttatcaatgcacccagcaacatacagtcgtgagattgactggcgcgagaaacacgaggtcgataatgaagcaaagtgcggtttattttgaggttttttaaatatttaataagagaattgacaatgaaaagaatgttaatcaatgcgactcaaaaagaagagttgcgtgttgcgcttgtcgatggacaacgcctttttgacttggacattgaaagtccgggacacgaacaaaaaaaagcgaatatctacaaaggaaaaattactcgcgttgagccaagcttagaagcggcttttgtagattatggtgcagaacgtcacggttttttacctttaaaagaaattgcccgtgaatattttcccgatgattatgttttccaaggtcgtccgaatatacgcgatattttggttgaaggacaggaagttatcgttcaagttaataaagaagaaagaggaaacaaaggtgcagccttaactacttttgtttctcttgctggcagttatttggtacttatgccgaataatccacgggcaggaggaatttctcgccgtattgaaggcgatgaacgtactgaactaaaagaagcattaagttcattagatgtgcctgacggtgtaggcttaatcgtccgtactgctggtgtgggaaaatcgccagaagaattacaatgggatttaaaagtattattacatcattgggaagcgatcaaacaagcttcacaaagccgtccagctccattcttaattcatcaagaaagcgatgtgattgtacgtgctattcgtgattatttgcgtcgtgatattggcgagatccttattgatagcccaaaaatttttgagaaagcgaaagaacatatcaaacttgtgcgtcctgatttcatcaatcgcgtgaaactttatcaaggcgaagtgccacttttcagccactatcaaattgaatctcaaattgaatccgcattccaacgtgaagtacgtttaccttctggcggttcaatcgttattgatgtaactgaagcattaaccgccattgatattaactccgcacgttctactcgtggtggcgatattgaagaaaccgcattaaataccaaccttgaagcggcagatgaaatcgcgcgtcaattacgcttacgtgacttaggtggattagttgtcattgatttcattgatatgacaccaattcgccatcaacgtgaagtagaaaatcgtattcgtgatgcggttcgtccagatcgtgcccgtattcaaattagccgaatttctcgttttggtttgttagaaatgtcacgtcagcgtttaagcccatcattgggcgaatcttcgcaccatatttgccctcgttgtcaaggaacaggcaaagtgcgtgataatgaatctctttctttatctattttgcgtttgctggaagaagaagcattaaaagaaaacaccaagcaagtgcataccattgtgccagtacaaattgcctcttatcttcttaacgaaaaacgcaaagcaatcagtaatattgaaaagcgtcataatgtcgatattattgttgccccaaatgaagcaatggaaacaccgcactttagtgttttccgtttacgtgatggcgaagaagtaaatgaattaagctataacttagcgaaaattcactgcgctcaagatgaaaatactgaagaatcactgctttctcgtaatgtggaaacaacagctgttattgaacaaccagcggttgaaagtgcagtagttgcactttctatttcagaagcagccccaacgccagttgagcgtaaatcaaatgaaccctctttgttagctaaaattattgcgaaaattaaaggtttatttgcgactaaatctgaagaaaacaaaccgaaaaataaccgcacttcgcgcaatcctaatcgtaatcaacgccgttcacaggatcgtcgttcttctcgtcgtccacgttctgaaaataacgaaacagaaagaaccgaagaacaggttcgtaatgtccgtgagcgtaatcaacgccgtccgcgccgtaacttagtggaagaaagtatcgctgaaagtgcggtaaattctacacctgtttttgaggctaaagaagaaagaactgagcctgtaactcaacgccgccaacgccgtgatttacgtaaacgcgtgcgcgttgaagataatgaaacagttgttgaaaataacttcagcacgactgaaaaaatgccagaagtggatgtaattacggttcaaaataatgatgaaaaacccgttcatcagaaccaacgttctgaacgtcaagagcgtcagcgtcgtactccacgtcatttacgtgcagcgaataatcagcgtcgtcgccgtgatcaagagccaaaatcgccaatgccattatttgctgcggtggtttcgcctgaattggcaagtggcaaggcttggattgattattcaacggtaaatctgccaaaagaaaatcatttcttatctgtggatgaattgcttgagcaagagaaaactaaaaaagggtttatcacgccagcaatgggaattgttgttgaagaaaaatcccctgatgtaaaacctgcattagattttattactcaaccagctaatgaatcggtacagaaaaaagtacaagaatctttagaccgtttaagttcatataaacctcaagaagttgttgaatctattgatcctgcaattaatgtagatgaacctgaaacgctcgagaaagtatcaaaatttgtccgcacttatgaatttaatggacgtttaggtacaatttcttcagtaccccatacaaaagcggagatgactttagcgaaagcaaatgatgaaatgccagaggatttcccaattagggcttggcaggattctcgttattatttctatggaaaaggcgcggcaggacatcattgtgcaattagccacgtttattctgaaccaacccgcacaaaatcagaataatcaaaaataaaaatagaattgacgtaaccaacattacgtcaattctttttattttataaatacagtttgattgaaagcataaaaaaccaatcagtcaaattttgctgttattttatgctttaattaaaacatttttacttatattatagaacagagtaagttgggcatgttgctaccagcggttacacaaaagatgaatttacaacaaaacttacatttaagactaacaatatgccaataggcggagatgtgaaggcggatcaggaaacatcaggttctagaagcataaaacgcattggctttggttttattggtggtattggctatgacattacaccgaatattaccttagacttaggttatcgttataacgattggggacgtttagaaaacgtgcgttttaaaactcatgaagcctctttcggagtgcgttaccgcttttaattaaacaaatttagttttctatttaagcggtcaaattcttctcattatttgcaaaatgagggaaaaatttgaccgcttgttttttcttgaaaagaagcgtaaacttctttcgacttttagtcggggtgccgaaaggctgagatgatacccgtgaacctgaaacagttagcactgacgtaggaaactaatatgccacatattcaacctttctctatcacgattttatcctgtttattttcccaattttctacattttattacacctgctaattgctcacagtgaatagcgggcatttttgtttattttatattcaacacaaggaatgcttatgcaatcaatttatctctccaaaatccgtgagcagaatccgctcattcataacattaccaatattgtagcagcgaattttagtgccaatggcttgttggcattaggagcctcgcctttgatgtcggcgaatgttgaagaaatgcaggaagtaccgaaaatcagtcaagcattggtcattaatattggtacgctgattggtaaagatcgggaggcgatgttgcaggcaggaaaaacagcaaatgaggttggaattcctgtagtgttagatcctgttggtgtgggggcgaccagttatcgccgtgagaccattcgtgagcttttagccgaggtaaaattcgcacttattcgtggtaatgcaggtgaactggctgccattgcaggcgagacgtggcaggcaaaaggtgtagatgcagggcaaggcgaagtggatttaaaagccgttgccgagaaagtggctcaacgctatggctgtacggtgttgattagcggggcggtggatattgtcagcgatggcacacaaactgcgaccgttcacaacggcacgtcattgttcccgaaagttacggcttcgggctgtttattgagtgctgtgtgtgcggcatttttagcagtaagtgaagggaattatttttctgcgacattagaagcctgtgtagcatacaccattgcaggcgagtgtgcggcgcaaggcttaaccacacaagtgggacagttccaaatccgtttgttggacgagcttgctgccctttcccctgaaaccattggacaaagagggcgcatcaatgagtaatgtgaaacaagttttaaccatcgcagggtcagacagtggcggtggtgcaggcattcaagcggatcttaaaaccttccaaatgcgcggcgtgtttggtacatcagcaatcacggcagttacggcacaaaacacacttggcgtatttgatattcaccctattccactgaaaacaattcaagcgcaactggaagcggtcaaaaatgatttccagattgcaagttgcaaaattggtatgttgggcaatgcagaaattattgaatgcgtcgcagattttcttgctgataagcctttcggcacgctggtgctagatcctgtgatgatcgccaaaggtggcgcaccgttattgcaacggcaagcggtgagtgcgttaagccaaaaattgctgccgttggcggacgtgattacaccgaacattcccgaagcggaagcattaacggggattgcgattgtggacgacatcagtattcaacaagccgcaaaagcgttgcaaaaacaaggagcgaagaatgtgattattaagggcggacattcgctcaattcgcaaagtgagctgtgccaagattgggttttacttgcagatggtcgtcattttactttgcaaagcccccgtttcaacacgccgcatacacatggtacgggctgtaccttttctgcctgtttaaccgcagagttggcgaaaggcgaaccgttgcaaagtgcggtaaaaacagcgaaagattttattaccgctgcaatttctcacccattgaatattgggcaaggacatggaccaaccaatcattgggcttacagtcgcctttaaggattgaaagatgaaaaatattcaaaaaatcttaccgctttactttgtggcaggcacgcaagattgccgtcatttgggcgagaacttgtcggaaaatttattattcgtgcttaaacaagcgttagaaggcggaattacctgctttcaatttcgggataaaggcaaattttcgttagaacatacgccctcagcacagaaggcactggcgattaattgtcgtgatttgtgccgtgaatatggcgtaccgtttattgtagacgacaacgttgatttggcgttggaaatcgaggcggatggcattcacgttgggcaaagcgatatgcctgtgcaagagattcgcgctaaaacagataaaccgctaattattggttggtcggtgaatcgtttagacgaggcaaaaattggggaaaatttagcagaaattgattattttggaattggtccgattttcccaacgcaatcaaaagaaaatcccaaaccaacactaggaatggcatttattcaaactttgcgaaatgcgggcataactaaaccgcttgtggcaattggtggggtgaaattagctcacgttaaaaccttacgagaatttggggcggatggtgtggcagtgattactgcaattacgcacgccgataatgtgcaagccgcaacaaaagcattacgggaggcaagtgatgaatacgcaaaatagtttaaagcaagtagcaacagcgacgatggtcggcactgcaattgagtatttcgataactacatttacgcaatggcagcggtattggtatttaaccatcaattcttccatgccgtagatccactttcagggcagattgcggcactttccactttagcacttacttttattgctcgccctttgggagcaatattgttcgggcatttcggtgaccgtttcgggcggaaaaatacttttgtgatgagcttgctgttgatgggtatttccactgtggttatcggtttgttgccaacctatgacagcatcggtatttgggcgacaattttgctctgtttatgccgtattgggcaaggtatcggtttaggcggagagtggggcggtgcagcgttagttgcggttgaaaatgctccagaaggtaaacgaggttggtatggtactttccctcaactgggagccccgcttggcttgttgttggcaaatggcgtattcttaggcattactgcgattttcgggcaagaagctatgactgaatgggcgtggcggataccgtttttatcttccgttatcttagtagcaattggcttatatgttcgcctaaaactgactgaagccccgattttcctcgcggcacttaacaagccaaaacctaaacgcttaccaatgttggaagttgtcactactcattttaagccgtttttcttaggaatgttggtttgcattgctggctatgtgctgttctacattatgattgcctttagccaaatttacgccaaatctgctccaacggtttcagaggcaggatacgcaatgggattaggattttccccgcaaatttttaccgctttattgatggcaagtgcggtttctttggcaataacgattgccgcttcgggtaaatatatcgacaaaattggacgaagaacttggttaatttggacaactgttggagttgcgatttttggtttatccttgccgttatttctcgaaaacggtacaactaccagtctgttttggtttttattcatcggtatggggttaattggaatgggctatgggccattagcgagttttttacctgaactcttccctactcacgcccgctattcaggtgcgtcactcacttacaacatcgcaggcttattcggggcaagtgttgcggcaatcattgccttaccactgaatgctcactacggcttaaaaggtgtggggatttatttaaccctaaacgctgtgttgagcttggttggattatggtttatttcagaaacgaaagataaattactatcctaagatttgaggaattaaatacaacctattaagcggttaaattttatataaaattccactaagaatttaaccgcactttcctttacaagccaaatattttctctacaataccccacctaacgatttaccttgagtaagtccctgacctgaaatcagacaaaagagaatattatgacaacccaattcaaaccagaattactttcccctgcaggctctcttaaaaatatgcgctatgcgtttgcttatggtgcagatgcggtttatgcaggccaacctcgttatagcttacgtgtacgcaataatgaatttaatcacgccaatttgaaaatcgggatcgatgaagcccattcccttggcaaaaaattctatgtagtggtaaacatagcgccccataattccaaactcaaaacttttattaaagatttacaacctgtcatcgatatgaaaccagatgctttaattatgtctgatccaggcttaattatgttggtgcgtgaaaatttccctaatattgatattcacctttctgtacaagccaatgcggtaaactgggcaacggtaaaattctggaaacaaatgggattaactcgtgtgattttatcgcgcgaactttcaatagatgaaattgctgaaattcgccaacaagtgccagatattgaactcgaaattttcgtacatggtgcattatgtatggcgtattctggccgttgcttactttctggctatatcaacaaacgcgatccaaatcaaggcacttgcaccaatgcttgccgttgggaatacaaaatggaagaaggcaccacggatgacgtgggcaacatcgtgccgaaaatcgatcctgctcaacaaattgaagtgaaaaatgtagcaccaaccttaggcgagggtgcggtaacggataaagtcttcctttataccgaatcacaaaagcctgacgaacaaatgacagcgtttgaagataaacacggcacctactttatgaattcaaaagatctgcgtgccgtacaacatgtagaaaaattgaccgcacttggtgtgcattctttaaaaatcgaaggtcgtactaaatcattttattattgtgcaagaacggctcaagtttaccgcaaagcaattgatgatgcagccgcaggcaaaccatttgatgaaagtttaatggatacgttagaatcccttgcacaccgtggttataccgagggtttcttacgccgtcatacgcatgatgaataccaaaactacgaatatggctattctatttctgatcgtcagcaatttgtcggtgaatttacgggcaaacgtaacgaacaaggtatggcagaagtagcagtaaaaaacaaattcttacttggcgacaatgtagaaatgatgacaccacaaggcaatattaatttcaaaattgaaaaaatgctaaatcgtaaaaatgaaacggttgatgccgcactaggtgatgggcattttgtattcttaaatgtgccacaagatattaacttaaattacgccttattaatgcgtaatttagttaataccaatacaagaaatccacattctaattaacatgctccccgctctaaaggacggggatttctactagctcccacgctccaaaacgataaatatttattgtattttccttgataatgtacgtctattagacgtaaaatataagatattattaacaacataaggagtagatgaatgaaaacacaagtaacaaaagcaagattggaggctaaagtaaacatagatatatacgaattgctaaaacaagctgctgcaattacagggcgaacattaactgactttgtggtaagtgtagcttacgaggaagctaaaaagaccatttcagaacatcaagttttacgtttagcagtgaatgatcaggcattgctgattgaaagtctaagtaaaccatttgagcctaatccatcaatgaaaaatgcgcttgatgtgtatgaagcatatctatctattacagggaaaaataatgataaatgaaaatttagcatatttaagtgtattacccttagaagatttaaagattgagagaagttcattttcttgttcagttgaacctttagaaaagtattttcataagtacgtttctcaagatgtaaagaaagggcttgcaaaatgttttgtacttataaatgaacacaatctaggattgttggctattacactttatcggcattatcaataccaattacagatataccaaaagaacgaataagtaaaggtgtaccatatcctaatattcctgctgttttaatagggcgattagccattgatacgaatttccagaagcaagggtatggaaagtttctaattgcagacgccattcataagattaggaatctacggtagctgccacaattttagtcgttgaagcaaaaaatgatgatgccagctcgttttatgaacgattagggtttattgaatttaaagaatttggaggaacacacagaaagttattttatccgctaacaaaattaataaaatagatgaaaatcccctcttaagaggggattttcatctgtgttataaatacaccaaatattattgattttattcacatatctatactagcaacgagtgtgcgaaacgaagcctataaattttttttcataagaaatccttaattatttaagattattaaattgaactagaacaaagcaaagctatactatacaagcctaaacattactgttacttggcttgcgtcgtttgccgatatttttcgtatccttatgacgcaattttacttttttctttgcctctgtttttttcttttcttcacgtttttctttaatgcgtgccttttgttttttgctgacagatttcacttcgccatcttttggtggcttagtgcgaggttctaaacctgctaaaatgcgtgcctttaaaatttcctcagtataacgtttgattttacctagcaacttgtaatcatgcgcttcgacaaaagagactgccgtgccttttttgccagctcgcgcggtacgtccaattcgatgcaaataagtatccgcactatagggcaaatcaaaattcatcacgtggcttacatcgtcaatatcaataccacgtgcagccacatctgttgcaaccaataccgtcacaatacctgatttcaatttatcaatggcattgttacgttgagtttgtgccatttcgccttctaaatatgcggaacgaatgcctcgtttacgcaatgtttcggaaagttcacgtgcatcttcacgacgacgaataaacacaattccacgggttacttcttcagtttcaataaaacgcgcgagcaatttgattttgtgttcattgctgtctgcgtgataataccattgattgattttttttctttcacggcgacttggttccgcatctactttcacaggatcattcaataaacgctccgcgaaatcgaccaataactctccttctaaggttgcagaaaacaacaaagtttgttttcgccaacgggtttcagctgcaattttttccgcatcttgcccaaatcccatttgcaacattctatcggcttcatcaaaaatcagcatttcaacggaacggcaatcaaaattttcttccttaatgtattgcaacaaacggcctggcgtagccaccaccaaatcttgattggtattgaatacatcaccgtgattttgatacgccacgccacctgtaattgtcgcaatatttaaatgggtgaactgcgctaattcttccgcttgttcagccacttgcattgccagttcacgggttggtgttaataccaaaatacgtggtgggcctggtttacggcgtggataatccaataaatgttgtagcgcaggtaataaaaaagcagcagttttccctgttcccgttggtgccgagcctaatacatcactctcttccattgcggcaggaatggcttccatttgaatagctgttgggcgggaataaccttttttctcaagtgcctttaaaagctcaggagaaagatcgaattgttcaaattgggataaattcattattgtgcggttctttgttaaaattgtcgaggattatacctgaaagtgcggtcaatttacgaaaaatttatgagcagatttacctttaaacagttccatatcaatcaaaattcttgtgcaatgaaagtcggcactgatggcattttgttaggtgcttgggctgatgtaaagcattgtaaaaatattttagatatgggctgtggcacaggattattggcgttaatgttagcacaacgaactgaagaaaactgtcaaattcaagcggttgagttggatcccattgcagcaaaacaagcacaagaaaacatcaataattcagtgtggaaaaatcgcattcaacttactcaagtggatatacaacattttttacaaaccactgaacaaacctttgatttaattgtggcaaatccaccttattttgaacaaggtattgcttgtaaaaatgaagaacgagaattggctcgttataccaagcaaagccacttaaattggttagaatgggctgcaacacgcttgtcggaaaatgggagaataagttttgttttgccttatgaggcaggcaaaacgctcacaaaatccaccgcacttttttgcataaaacagacgaatgtcatcactaaaataggaaaaacgccccagagaatgttgcttacctttgccaaacaacccgaagttttaatgcaagatcaattggtaatttatgatgcggataatcaatacacggaagcgtttattgaattgactaaagacttttatttgaaattttaaaggggaaattcattttcccctttaatcatacactatctaaaataccacttcgctaacaacacacccgcattcactgcaatgtttaagcctgatttaattgggcttgcgagcgttaaacgcgcttgtgtatcttctggcgtcgctaaactttccgtagaactttcacttagcacaaaaaccactttattttttaaccgcactttatccaatgggtcgccttgtttattgtgcgatacgtgaataatttgatagcctgatttacgcaattgcattaaagctgaatcaatataatccgcttctaacacacgaatatattctgcaccaccttctgctacgcgcattgaggctgccgaatacagattttccacattatcggcgacaatatttttcacgccaaaataagcgcaagtacgcaatacgccaccaatattttgcgcattattcacgttgtccaatagcactaaacaatcctcgttacgaggaatatccaaatatccttgcaacgtgaaagcacgcggtttcttcactaataagcaaatgccaccgtgatgttctgttccactcactcgagctaattcttcactatctacaacgtgataagccttcttgttttcggctaaataactcaatacctcgccaattttgtgtgacatttgcacggttgcccacaatcgaacaatactttcaggacgttctgcaaataaagctaaacaggcattttcaccgtaaaccttcatttcttccgcacggtttttcttaattttttcaggtgcacgaggagaaagtgcacccgttttcttttcttttgttttataaaccgtacccgtactttttattgtcacttgaaccttaggttgttctgcatttttatttgatggcgcacgagataaagaaagttgcgtaattctagtttctttcacttcttgtttatcacgaggaaaacgagatttttcgtttctatttccattaaatttatcattaaagtgcggtcgattttgagttggtttttctctgtacttttcccccactgagcgttcttgaaaggttttgcctgcggattgaaaagagggtttgcgtttgtcgttcatagggtttccctgagtaaaaatggctgttttttagccaaaaaatgctaaaatttgtgagcattataacgaaaaaaagccttttttctattaataagcacgtgaaatattgtaaactaacgcactagtctttaatcacgagatggattatgttaatcaataaaaccaaacgagctgaacaaaatttaaataatttgccattccttgctttgcaagctgagcaaattgaatttttgggtagctcggctgaatttaaaactcaaattattgaattaatcagaaacgcaaaaaaacgtatttatgtcaccgcactttattggcaaaaagatgaagcggggcaggaaatcctcgatgaaatttatcgcgtgaagcaagaaaatccacacttggatgtaaaagttctcatagattggcatcgcgcacaacgcaatttattaggagcggaaaaatctgccactaatgcagactggtattgcgagcaacgccaaacttatcagttacctgatgatccaaatatgttctttggcgtgccaattaacacacgcgaagtttttggtgtattgcatgtcaaaggctttgtatttgatgatacggtgctttatagcggtgcaagcattaataacgtctatcttcatcaatttgaaaaatatcgttacgaccgctatcaaaaaatcactcatgccgaattagctgattcgatggtaaatttcatcaatgattacttgttagatttcagtgcagtttatccacttgatgtgaccaaccgccctcgcaccaaagagatccgtggcaatattcgcgcttatcgtaaagaccttgctcaaaatggtgaatattcattaaaaagtgcggtgaaattaccgaatgttttaagcgtatcgccactgtttggcttaggcgcatcaggcaatgaattaaatcaagtaattgaagatttattcttacaagtacaaaaaaaattagtgatttgtacgccatattttaatttcccacgcacattgcaacataaaatagcaacgttattggaaaacggtaaacgagtagaaattattgttggcgataaagtcgcaaacgatttttacattccaccagaacaaccattcaaaatggcgggggcgttaccttatctttatgaaagtaatcttcgccgtttctgtgaaaaatttgagactcaaattgaaagtggtcagcttgtggtgcgtttatggcgtgatggcgataatacctaccacttaaaaggtgtgtgggtagatgaccgctatattttactcacgggcaataatcttaaccctcgagcgtggcgtttggatgcagaaaatggcttattaatttacgatccacaacaacagcttttagcccaagtggaaaaagagcaaaaccaaattcgccaacatacaaaagtattaaaacattacactgaattagaagaattgaatcaatacccagaaccagtgcaaaaacttttgaaaaaatttgcacgaattaaagcagataaattggtgaaaatgattctgtaattataagaaaagttttatattttttcttaaattcgcttccagtattaatctgataaattttgtggcaatcgttctaaaatggctttccaataggttgaagaacgtaaattatgtttacggatgcaatccactactgcatctgcatttccctcaagacaaatttgttgcatttctaaataaaattgctttgttaattcacggtgttttttttctttaaaaaataacaaccctattcgctgataaacgccttttaaactattgaaaattaaacgataaaagggtttgttggcaacaacagtgaattgacgaaataattggtaatcaaattctgtgtaatcttgtgctgtgttttgtaattgctctaattcagcaaaaagtgcggttgatttttgaggggaattttttactgcttcataaatgtaagattccgacattttactacgtaaagagagcatattatcaataattaagggcgcagactgcatatccaaagcaattaaggtttcaataatattcggccctgcagcatcccaaatattatttactttggtgggtttgccgtgctgaattgttagccaaccatcacgagccaaacgttgtaaaacttcacgtagggtggtgcgagttacaccaatcttatcggctaaatcacgttctgatggcaaattactgcccgcaggaaaaacatcttgccaaatactctttacaatatattcctctgctaaagctgctggactttgggcttttaaaatgtcgttattgttttgcattacaattaaaaatcagataaaaatcaaaaaaaatgcaattttataaaaaaattacttggtttttattatcctttaaagggggatatattacaatgttcgcgtgataaaaataatggagttcactatgacaaacattcaggcttttatgaaaaactttcttggggcaagtccagaatggtacaaacttgccattgtggtttttcttattataaatccaattgttttcttttttattagtccttttattgcgggttggttactggttgcagaatttattttcacattggcaatggcattaaaatgctaccctcttcaaccaggtggtctattagcaattgaagctattattattggaatgacaaatgccaaacacgtcaaagcagaaattatggcaaactttgaagtgatcttgctactgatatttatggtggcaggtattttctttatgaaacaattactgctttatgtatttactaaattacttgtcaaaattcgttctaaaattgcactttctattgccttttgttttagtgctgcttttttatcggcttttctcgatgctttaacggttgttgctgttatcattagtgtcgcaatgggattttatggtgtgtatcacaaagttgcatcaggcaataatttaattgatgcggttgatatttcagacgatagaaaaattattgaacaacagcacgaaatcttagaaaaattccgtgcattcttacgtagtttaatgatgcatgcgggtgtaggaactgcactcggtggtgtaatgaccgttgttggagaaccacaaaacttaattattgcagaacaagcaaaatggaactttatggaatttttcctccgtatggcacccgtgactattcctgtgtttatctgcggattactcacttgtttcttggtcgaaaaattcaaattatttggttatggcgagaaattaccagacgaagtgtggaaaatcttatcagatttagatcgcactaattcagaaaaaatgtctaaacaagataaaattaaattaggtatgcaagcgttaatcgcaatttggttaattgttggattagcattccatcttgccgcagtcggtttaattggtttaagtatcatcatttttgctacgtctttcactggtgtgacggatgaacatactatcggtaaagcctttcaggaatctttaccctttactgcattgctcgttgtattcttttctgttgttgcagtaattattgatcaaaaacttttttcaccaattattcacttcgttctttctgcggaagaaaatacacaacttgctttattctatttgtttaatggcttgctttcttctatttctgataatgtatttgttgcaacggtttatattaatgaagctaaagctgcactgactaatggagtaattgcaccgcatcaatttgaattgctttctgttgccattaatacaggtacaaacttaccatcagttgcaacaccaaatggacaagctgctttcttattcttattgacttcatcaatttcgccattaattcgcctttcttatggcagaatggtttatatggctttaccttacacgattgtactttcaatcattggtttactggctattgaatttattttaccagctgccacaatttggttagcaagtttaggtttaattttgccaatttaaggagaaaaaatgctcgcgctattaaaacaattttctgaaaaacgttttgtgtggtttttattggctttttcaagtttagccttagaatccaccgcactttacttccaatatggaatgggcttacaaccttgtgtgctctgtgtttatgaacgtttagcaatgattggcttatttgtagcgggcactatcgcattacttcaacctcgcgttttcatacttcgattaatcgccttggctttaggtttattcagcagtattaagggcttattaatttcatttcgtcatcttgatttgcaaatgaatccagctccttggaaacaatgtgagtttattccaaattttcccgagactttaccatttcatcaatggtttccatttatatttaacccaactggctcttgtaatgaaagccaatggtcattatttggtttaacgatggtgcaatggctagtggttattttttcactatatgtggttattctcacattattgttaatcgcacaagtgattaaaacacggaaacaaagaagattatttaactaaaaaatacggtgaaatttcaccgtattttttattacattaaaatcaaccgcactttattcaacggtaactgattttgctaagttacgaggttgatctacatcagtacctttaattaaagccacataataagaaagtaattgcattggaatggtataaaaaatcggtgcaacaatatcattgacttttggcatcgtgatgattttcattccttcacttggcgtaaatcctgcttctttatcggcaaatacgtataattgaccgccacgagctcgcacttcctcaatgttcgattttactttttctaataattcattatttggtgcaacgacaatcactggcatatcagcatcaattaacgctaatggcccgtgtttcaattctcccgccgcataggcctcagcgtgaatataagaaatctctttcaatttcaaagaggcctctacggcaattggataaaacgcaccacgacctaagaaaagtgcatgatgtttttcagcaaaatcctctgctaaagcttcaatttctgtatcaaaagctaacgctttttcaatttcagcaggtaaagattgcattgctttaataatttcacgttctttttctacagaaatatgacctttaactttaccaagtgccgtcaccaacattaataacgcagcgagctgtgtcgtaaatgcttttgttgatgctaccccaacttcaacaccggcacgcgtcataaatgcaagatctgattcgcgtacgagcgaagagccagcaacattacaaattgttaatgccgccatatagcccttttctttcgctaaacgaagtgcagctaaagtatcggctgtttcgccagattgagaaagggtaatcaataagctatttggacgggtaacaaatttgcgataacgaaattctgatgcaatttcaacatcacagctcactccagctaaagattcaaaccaataacgcgccaccatacctgcattataagatgtaccacaagcaacaatttgaatatgctcaactttttctaaaatgccttttgcaccattaccgattgaatcaacaatcacattttcgtgattgatacgcccttccattgtattaataagtgcggttggctgttcgtaaatttctttctgcataaaatgacggaatttgcctttctctgccgcgtcattttcaagattagactcgtgaatttcacgtttagccttattaccgtgagtatcataaatatcaactgtacgacgtgtaatttctgcaatatctccttcttctaaaaagataaaacggcgggtaacacttaaaagcgcaagttgatctgaagctaagaaattttcaccgatacctaagccaatcacaagtggactaccagaacgagctgccactaaatgttcaggatgacggctgtccattaccaccataccgtatgcaccagtgagttgttttactgcttttttcacagcgtctaaaagtgaatccgtcgtacgcatttcccattcaactaaatgcgcgatcacttcagtatcggtttgtgataaaaagacataaccacgagattttaataattcgcgaagttcttcgtgattttcaataataccgttatgtactacagcaaaagtacctgatgaatgcggatgcgcattagtttctgatggttcgccgtgagttgcccagcgggtatgtgcaattcccgttccaccaattaatggtttttctgatacggcttcatctaaagctttaactttgcctaaacaacgaatacgttgtaattcattttgtttattgattactgcaacaccagctgaatcataaccacgatattctaaacgatgtaaaccattaattaagatttccgctacatctcgttgtgctactgcgccgacaataccacacataagtttnccttatttattctattactaagtttgtttttacatttgccacgcgtttacacaataaaaaacccctgcgcaatcgacagggcttcatttcattgatgttatcaattatttgattgcatcttttaatgctttaccagatacaaatgctggcactttagatgctgcgatttggatttcagcaccagtttgtgggttacgaccagtacgagcagcacgttcatttactttaaatgtaccgaaaccgattaattgtacaggctcaccttcttttaggcttgcagtaattgcatctaaagtcgcttctaacgctgctttagcttgttttttgtttaactctgcagcgtttgcaattgcatcaattaaatctgttttgttcataaatttgtaccttctgttaaataaaaagtttgattctttaaaagtatctttgcgaatttgtcgcaaaaactgtgcaaaggataatctaacttgagatgaattaaaagcaggatttctaaaaattgtgacaaatctcacgttattgatgaaattctataccaawgttagatataccctcagtccgaatttcattttttaaagctaaaattaattcaatatcacgtttttcacattctttaagcaaacgataaacttgccattgcacatcaagttctgtttgaatatcttcattttcttttagcttactttctgaccaatctcgtccagtttctgtttccaataatacccttattgttcccaacgaaattaagcttatttccaccgctttttctaaggtttcgcccgcaataatggcgtgtaaaatttcagctaaagcctgacaggcatctaacgctggcacaacaccaaaactatcataatcattcacatccggaataatcgtttccaatttctccaactgattttcaaagttgatcttgacatctttaaccgttaaatattcccacaccaaattgagaatattttgatacgttttggtttccgcactaagctcgttcatttgacagaacaatttaaaatttggtgccatacgttcacataaagcagccataaaagtaagatgttgccaactttctaagttttctaagcgtttatgaatcggatttcgcatcttatttccttaattcgtaagagttggaatatttattaatcgcatttatgttccgctttacaaagttcaagcgtcacatgaattaatttgcgagcgatagtacccgttggcggtaattctggcaagggttgatcataagaaaaccattgtgcatcgtgaatttcactttcctgcaatgttatttctccgctttcataatcagcaagaaagccgaccatttgagagtttggaaatgcccaaggctggctaccgaaataacgaagattttttattgaaatccctgtttcttcaaaaacctctctctgcactgcttgttcaaatgtttcccctacttcgacaaaacctgcaagcgtcgtgtatattcctccgttagactataatgtcgcttatgatttgccaatagaatttcgtgaccacgacgaaccgcaacaataattgatgggcaaatcacaggataagtttgatacccacagtgaatacattgcacagcaagttcatcttgagtttgttgtgttttatgaccgcactttccacagaatttatgggttttcagaaaatgattaatttccacacctcggcttaatatatggaattcatcctctggcagtgaaagcaagttactcaaactcacatattctcgttcatcactttcttgctcagccacaagccacaacggataatttttccattccccaatttgcattgcctgcaatccttccaaatcaatatctttagcgataccaaaaggcaattcattattcactaaatacagattagaaccttgtgtaagcaaccaataaccaaaatcatcttgttgaagtattttcattttttctccataaaaataaccgcactttcaaaagtgcggtcattataaatcttcttttataactcactaataataagaatgttcgccacgttgatgctcagttatatcttttgcaccttttaattcattcgggaataagctaacaagttgtttttctaccccatcttttaacgtaacatccaccattgaacaaccgttacagccaccaccaaattgtaaaactgcgtaaccatcttcagtaatttcaattaaggttatacgtccaccgtgatttgcaagctgtgggttaatttgagtttgaattacatattcaacacgttcaatcaatggcgcatcatcagccaccttacgcattttggcattcggtgcttttaaggtcagttgcgcaccaagctcttcggtaacataatcaatttctgcttcttctaagaaaggcaaactcacttcatcaataaatgcagaaaaagtattatatttcatttcaatatcgctttcttccacggcattcggggggcaataagatacgccacattccgcattaggcgtaccaggattaaccacgaaaatacgaatatgcgttccttcttcttgggtgtctaaaagttttcgaaaatgcgcttgtgcggcatcagaaatagcgatttgctgggttgcttgttccataattatgtcctaaatacttgagagaaagtatcgggaataatacgcttatcgcgcttttttttccagtgctttatattaagctcgtgccagcccccacacttgaatctcctccacacctaattttcgcaacaattttgagatttcattgagtgtagaaccagtagtaatcacatcatccaccaacgcaacacgacgataaggaaattcatttttcgaaacagcaagagaaaaggcattttttaaattctgacgacgatcttttgcactcaaaccacgttgagtataggtgtgtttcacacgctttacgatattgttcaaattaggaatatccagccaacgacttaattgctgagataataaatctgcctgattataaccccgtcgccactgacgaaaatgatataaaggcactggaatgattgcctctggcaatttaagttgatgcgttcgtttagcatcacgtaccgcaagatataaaagccgagctaaagtgcggtcaatccaaaattgattttgaaatttaaaacgctgaatcaatatcgaaagaggttcaatataatgcccaataatgaccatcttatcccaacttggttcttgtttaagacaattcccacaatgctgcgcataatattgcaattccgaaccacaatgaccgcaataaggaaaagatttaatttgtttttggcaacctgaacataacccattttttgcgatatgaagattgccacgacagtggatacagcgaaaattaaaaaaattcatcatttaaaaagttattttttaccctcacttttttgtttcaacgcctctaacgtttctcctgcttttaaaatatgtggcgtgacgaaaatcactagctcacgtttttgatgtcgttcactttctttgctaaataatcgtttaataacgggtatatcgccaagcaatggcactttatcttcgcttttcgtgattgtatcgtgaaatacgccgccaagcacaatggtttccccatctttggcaaaaacctgagtattaatttcttgtttatcaatagaaaccacctcattttgtccataagcgacacgagaaccaggggaattttgacttaccaataaatcaagtaagatattgttatctttagaaatatgtggcgtcacttccaaaccaagcaccgcctcacgaaattccacagattgcgtatcgttacgagtattactcacgatgtaaggaatttctgtcccctgtttaatgctcgcacttttcttattggtagtgagtaagcgagggcttgcaataatttctacattattttcacgctccaacgcactcaattctaaatcaagcaatcgcccattaattttggcgacttgtaatgctatagagccagcaggtgtcgtcgttgtcgcaaaatttacattaagattatccgcaatattttcaaagctattgcctgtaaggctgcccgcaactcgtcttgcattttcagttggattaaaaatcccccaccgaacgccaagttctttcaaactctcatccgtaattgtcacaattcgcgcttcaatagcgatctgttcaataggcttatccatttcagcaatcagttttttgatattttgcacagaacgaggttcatcctgaataaccagcaaattactgcgatcatcaaaggtaatgctcccagcgggagaaagcaaagagccacttcctgttgttaaggatttcattaattcagaagctttagcaaaatggagttttaccgtgtgactcactaagtgcggttcatttgtcgtaagatttcctgcaacctgacctttgccagattgactgccgtttaaataataaatcccatcatctttattcaaagtaagatgcttactttttgcgattatttgtagcaaacgtggcatatcaatattgtttaatttcaaagagatcttgttttccaatatatctccaatcactaaattcacatcttgttgaaaagctaattgctccagtgtttgagctaaaggtgcttgcgataaacgaataaaaaaacgttcgttatctgttttaggattagcaaaaacgattaatggcaaacaaaaacatactaaaaaataaccgcactttaaaaaatatttcttcataatcttcctttaaaaacttaattttttccattcactactatcacattgctctcctagcttacgcataaattgaacattgttttggttgattttttctacaatatagccctcttgagccacatcaacgccctctaaaacgctgtaaacttgcaaaccttgatcttgcaacaaggcaaaggctttatctttagaaatcactacccccaccaattttaaagcgttcaaaggaatttcagccgcttggcgattttcatccgctccgcatagattattaggcacatctgaggaaattatttctgtttgctccattactgtttgtgcgttatcaaactgagaacggttacgctgtgttttatcgaaaggatcttgtccccaactgcaattcataaaaaataatataatcaggaaaaaccaatgtttcattttgtttccttatctagctgaaaaatgatctcggtttgcaatgggccgtcttcgggtttcataaattgcaaccgacttacagaaagctgtgacgaattagccaaaagtgcggataaaaatgtcttcgttttttcaaaatgacctgtaagctgtaaatgcaaaataggcttttgccccatttcccaacgtaaatgctgagataaaccgttacgcgcagctaaacgttgaatttgtttattcaaaggaataatttgtgcagccagttctggagaaagttttcgactttccgactgctgttgtaaagaggttaaaattttctgttgatgcaacaattctgaacgtttcaccgctaactcattttcaatttcatggaaacgtgaactcccctctatataatctaaaacggggcgaaaaatcaccgcacttaatagcaataaaaaggttaaaccgtgcacataaaaaggctgacttagccattttccaaaaggagtaaaaggatcgttaaaaaaagctttcatttttccgccccttgttccacatcaaagtgaaaaaacaatgtatcttgttcaggttgaacctgacttaatttcacattgggaaaatgtttctttaaaaattgatgaatcagttcaaattctgtttgatcttgcgcgttaccttccaagcttaagttattggcatcttgtttaaatttattcagttctccttgttgaaaaggtaattcacttagctgttgtaaactcttttttacttgctcgttgggaatagatgtcaaaacttcaccaactttcaccgcaatgcgtaactgatcaatttgcatggtagttttatgaagctgttgattaagttgttcaaacgacttttgctgtgcctgcaaattttgtttctgttgttcaatcaaattgctaaaagccaacattaaattaatagcaagcaagataaataaagcgatataaaaagctaaacgacgtaaacgcttttgatgttgataagtacgccaaggcaataaattcatcgacatttaaccacccactttttgttgatgtaaatctttttgccatagcgcgttgcccagcgcaataaaagggagttctgtttctactcgctgccagttttcgggtaatggtgtatgacttgagggaatttgataaacaaaaacttgttcaagttgtccttcaaaacgttcggtaaattgttcataaagtgcggtcaaattttcgtgagattgtaaaatttgtgattgctgagatctttcacaaatcgccaagcaatagtcatcttcttgaaataaaaataaggtattttctgaccgcacttgttcattcaacagatattgaaatgcacgcaaaacagcatttgacgcaacatccaatatattaatattaaatggctgaaaatcttgcaaataagtttgagcgctacttttacgaattgcagtaacctctaatcgaaaaccttgctttaacggggtagaacgataatcaaaccacaattcttctaaaaaaataggcagctctttttcaatcacaaatttacattgttgatgacattcttgcgcatttaacacttgtggcaacattaatactttcgaccaagttaagtgggcgggaatgcttgctacaaactgcaaaggaaaggttttcccttgatattgtgtttttagctgttgtaaaaaacgatttttaaaataacgatcattaacaaagatttgataactttgtggctgttcgagatcatcaaaccacacaaaatcaaaataactctgcttacgatgaatgccgatttgtaaagtgcggtaatttttcagggagaattgcatattctttcctattctttaaaggctgaatcttttatacttaacagccaaatcataggtctcttgacaagaatattcattaacgaagcgagaattttacgatgcggatcgcaaaattaatattaaacaccctattaactttatgtattttaggtttagtagcaggcggaatgttgtatttccacttaaaatctgaattgccctcagtagaaacattaaaaaccgttgaattacagcaaccaatgcagatttatacggctgacggtaaattaattggcgaagtgggtgagcaacgccgtattccagtgaaattagccgatgtgccacaacgcttaattgacgcatttttagcgacggaagacagtcgtttttacgatcatcacggattagaccctatcggcattgcccgtgcattgtttgtcgcagtgagtaatggcggtgcatcacaaggcgcaagtacgattactcaacaattagcgcgtaactttttcttaacctcagaaaaaaccattattcgtaaagctcgtgaagccgtgcttgcggtagaaatcgaaaatactctcaacaaacaagaaatattagagctttatttaaacaaaatctttttaggctatcgttcttatggtgttgcagcggcagcacaaacctatttcggtaaatcattgaatgaattgaccttatcggaaatggcgattattgctggtttacctaaagcaccttcaacaatgaacccgctttattctttaaaacgttcagaagaacgccgcaatgtggtgctaagccgtatgttagatgaaaaatacatcagcaaagaagaatatgatgctgcattgaaagagccgattgtggcgagctatcacggcgcaaaatttgaatttcgagccgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattacgatatgcgtcacggttatcgcggtggcgcgccattatggcaaaaaaatgaagccgcttgggacaatgatcgcattgtcggttttctacgcaaactacctgattcagagccatttattcctgcggcagtgattggaattgtaaaaggcggtgctgatatattgctcgcttctggggaaaaaatgaccttatcaaccaatgcaatgcgttggacaggcagaagcaatcctgtgaaagtcggcgagcaaatttggattcatcagcgtgctaatggggaatggcaattaggacaaattcccgcagcaaattcagcattagtttctcttaattcagataatggtgcgattgaagcagtggtcggtggctttagctatgaacaaagtaaattcaatcgagccacacagtctttagttcaagtgggttcttctatcaaaccatttatttacgcggcagcattagaaaaaggcttaacactttcaagcgtattacaagacagcccgatttctattcaaaaaccgggacaaaaaatgtggcaaccgaaaaactcgcctgatcgttatgatggcccgatgcgtttacgcgtaggattaggtcaatccaaaaatataattgctattcgtgctatccaaacggcaggtattgatttcacagcagaatttttacaacgttttggttttaaacgtgatcaatattttgccagtgaagccttagcacttggcgcagcctctttcacaccattagaaatggcgcgagcttatgcggtgtttgataatggtggcttcctcattgaaccttatatcattgaaaaaattcaagataacacgggtaaagacttatttattgcaaaccctaaaattgcttgcattgaatgtaatgatatacctgtaatttatggcgaaaccaaagacaaaatcaacggctttgccaatattcctttaggcgagaatgccttaaaaccaacagatgacagcaccaatggcgaagaattagatcaacaacctgaaactgtgcctgaactgccagaattacaatcaaatatgaccgcacttaaagaagatgcgattgatttaatggctgctgcaaaaaatgcttcgtcgaaaatagaatatgcgccacgtgtcattagtggcgaacttgcttttctcattcgtagtgccttaaatacggcaatttatggcgaacaaggtttagactggaaaggcaccagctggcgtattgcacaaagcattaaacgtagcgatataggcggtaaaacaggtactaccaacagttcaaaagtggcttggtatgcgggatttggtgcaaacttagtaaccacaacttatgtcgggtttgatgataacaaacgagtacttgggcgtggagaagcaggagcaaaaacagcaatgcctgcttggatcacttatatgaaaacggctttgagtgataagccagaacgtaaattgtcgctaccgccaaaaattgtggaaaaaaacattgatactttgacaggtttgctttctccaaacggtgggcgcaaagaatattttattgcgggaacagaaccgacacgtacctatctttcggaaatgcaagagcgtggttattatgttcctactgagttacagcaacgcttaaataatgaaggcaatacgccagcgacgcaaccacaagaactcttctaaaaatgaccgcactttagtgtgtaatcgggcgagtcaattggctcgccttcgttattaaacaaataaggaatatataaggaatatattatgctgagttatcatcactcatttcacgctggcaatcatgccgatgtcttgaaacatattgttttaatgctcattttggaaaatcttaaactcaaagaaaaaggctttttttatttggatacgcactctggtgtggggcgttatcgtttatcctcaaatgaatcagaaaaaacgggggaatataaagaaggtattggacgcctgtgggatcaaacagatttacccgaagatattgctcgttatgtaaaaatgatcaaaaaactcaattatggtggcaaagaactacgttattacgcgggttctccattaattgccgcggaattgttgcgctcacaagatcgcgcactattgaccgagcttcatcctagcgattatccaattcttcgcaataattttagcgacgacaaaaatgtcaccgtaaaatgtgacaatggctttcaacaagtcaaagcaacgcttccgccaaaagaacgccgaggcttagtactcatcgatccgccttatgaattaaaagatgattatgatctcgttgttaaagccattgaagagggctataaacgttttgccactggcacttatgcgatttggtatcctgttgtattacgccaacaaactaaacgtatttttaagggtttagaagcaacgggaattagaaaaattctaaaaattgaactcgccgttcgcccagatagcgatcaacgaggaatgactgcgagcggtatggtggtaattaatccaccttggacattagaaacccaaatgaaagaaattttgccttatctcacaaaaacattagttccagaaggtactggaagctggacagtcgaatggattacaccagagtaattctccattataaacgccactaaatttcaccgcactttatagcttaaaagtgcggtaagattttctaagattttaaataaatcccacagttcccaaaagcccattttttcgctagaatgcacgcaatttttgacttaataaaggataacattatgtttggaaaaggcggtttaggcggcttaatgaaacaagcccaacaaatgcaagaaaaaatgcaaaaaatgcaggaagaaatcgcgcaactagaagtaacgggtgaatctggtgcaggtttagtgaaaatcacaattaatggtgcacataactgccgtcgcattgacattgatccgtctttaatggaagacgataaagaaatgttagaagatttaatcgccgccgcttttaacgatgcggtacgtcgtgcagaagaattacaaaaagaaaaaatggcatcagttaccgctggaatgccattaccaccaggaatgaagtttccgttttaattattaggcgcgtgaatataagattcacgcgtcatctctcagtttcctctcattaatcactatgcaaagcagtccacttttagaacaccttattgaaaacttacgttgtcttccaggcgtagggcctaaatctgcgcaacgtatggcttatcatcttttacagcgtaatcgtagcggtggaatgaatttagctcgagcactcacagaagccatgtctaaaattggtcattgttcacagtgtcgagactttacggaagaagacacttgcaacatttgcaataatccacgccgtcaaaattcaggtttgctttgtgtcgttgaaatgccagcagatattcaagcgattgagcaaacggggcaattttcaggacgttattttgttttaatgggacatttgtctccacttgatggtattggacctcgtgaaattggcttagatttactgcaaaaacgcttagtagaagaatctttccacgaagtgattcttgcaacaaatccaacggtggaaggcgatgcgacggcaaactacattgctgaaatgtgccgccaacataatatcaaagtgagtcgtatcgctcacggtatccctgtcggtggtgaactggaaactgtggacggcacaacgcttactcactcttttcttggtcgtcgtcaaatcgactaatcttctcataccattatgcgtttatttatcgccgaaaaaccaagcttagctcgcgctattgctgatgtgctcccgaaaccccatcaacgtggggatggttttattaaatgcggcgataatgatgtggtaacttggtgtgtagggcatttgctcgagcaagcagaacccgatgcctatgatcctaaattcaaacaatggcgtttagaacatctccctatcattcctgaaaaatggcaacttttaccgcgaaaagaagtaaaaaaacaactttctgtggtagaaaaactgatccatcaagcggatacacttgttaatgcaggagaccctgatagagaaggacaattacttgtagatgaagtgttcagttatgccaatttatctgccgaaaaacgcgataaaattttacgctgtttgattagcgacctaaatccaagtgcggtagaaaaagcggttaaaaaattacaacccaaccgtaattttattcctcttgccacatccgctctcgcacgagctcgcgccgattggctttatggcattaatatgaccagagcttataccattcgaggtagacaaactggctatgatggcgtgctttctgttggacgagtgcaaacccctgtgctaggtttaattgtacgtcgagatttagaaattgagcatttccagcccaaagacttctttgaagtacaggcttgggttaatccagagagcaaagaagaaaaaactccagaaaaatcaaccgcacttttcagtgccttatggcaacctagcaaagcttgcgaggattaccaagatgatgacggcagggtgctctctaaaggattagcagaaaaagttgtaaaacgtattacaaatcaacctgcagaagtcaccgaatacaaagacgttcgtgaaaaagaaacggcgcccttgccttattcactttctgcgttacaaattgatgcagcaaagcgatttggtatgtccgctcaagccgtattagatacgtgccaacgcctatatgaaactcatcgtttgattacttatccgcgttctgattgtcgctatttgcccgaagaacattttgccgaacgccataatgtattaaatgcaatttcaacccattgtgaagcttatcaagtcttaccaaatgttattttaactgaacagagaaatcgctgttggaatgataaaaaagtagaggctcaccatgcaatcattcctactgccaaaaatcgtccagtaaatctaacacaagaagaacgtaatatttacagccttatcgctcgccaatatttaatgcaattttgccctgacgcagaatatcgtaaaagtaaaatcacattaaatatcgctggcggtacttttatagctcaagcacgaaatttacaaacggctgggtggaaagaattgttaggcaaagaagacgacacagaaaatcaagaacccttattaccaatagtaaagaaaggacaaattttgcattgtgaacgcggagaagtgatgagtaaaaaaactcagccaccaaagcccttcactgatgcaaccttgctttcagcaatgacgggcattgcgcgatttgtgcaggataaagaactcaaaaaaattctgcgagaaaccgatggattgggtacagaggctactcgcgctggcatcattgaattactttttaaacgcggttttttaactaaaaaagggcgaaatattcatagcacagaaacaggaagaattttaattcaggcattaccaaatattgccacccaaccagatatgacggctcattgggaatcgcaactcacagacattagtcaaaaacaagcaacctatcaacaatttatgcataacttgaatcaaatattgcctgatttagtccgttttgtagatcttaatgcattaagacaattaagccgcattaaaatgattaaatccgatagagcgaaacctaaaagtgcggtaaaaaaatcgagtaaatcaaacggtgagactgattaaagttaaaccaattaatattttttttatgcaaagcacttgcaagaaaattgaattttctataacattcacgaccagttttcttgcaaaattgcaaattagagagaaaaaatgtatcaagttcttttatttatttatgttgttgtcgcgattgccttgatcgggtttattctcgttcaacaaggtaaaggagcgaacgcgggcgcatcttttggtggtggtgcatcaggtacaatgtttggctctgctggtgcaggtaactttttaacacgtactagtgcgattttagcaaccgcattttttgttattgctcttgttttaggtaatatgaattcacataaaggcaatgttcaaaaaggtacttttgacgatttatcacaagctgcagagcaagttcaacaacaagcagctccagcgaaagacaataaaaatagcgacatcccacaataaaataggattagcataaaattaacgctctggtggtggaattggtagacacgctatcttgagggggtagtgaccacaggtcgtgcgagttcaagtctcgcccagagcaccaaattaaaaatatacagcactaaaagcattacaaagccttgattctactgaaatcaaggcttttttattccctatactccactataaaatactatcgaaccttagaattttagtaatagacttaataatatattcacgctaaggcaaaaaaatcatagagacttgtaaataccaggattattacctagtttgctatattactaagtagggctattttatggcatacttaacaaatccgctttctgacacccaaattaaaaaagcaaaactgaaagaaaaagattgctcctacttttacaaacgattcacgaatacatccataactaaaaggactaagccctgtagattacagagcctagtccttgatttcatagtctaactttttcaatgaaaattattttttacattcaaagtgcggtattattccgcattgtttttcgatttaataatggcgtaaaccacacctgttgataaagcaccaatcgcaattgcaccaagatatttcaacggctcagacacaaatggaatgacaaataatccgccgtgcggagcttgtaaggtaatatttaatcccattgaaatcgcaccagccaccgcaccaccaatcacagagctaataatgactcgaattggatctgctgccacaaatggtaatgctccttcagaaataaaacataaaccaagaacaaatgatgctttccccgcatcgcattggctaacggtaaatttattgcgagcaatccaagtcgcaacagtcataccaattggaggaaccatacctgcggccattgccgcagccattggtgtataaacttgggaagcaatcaatccaaccgaaaaagtgtacgctgctttatttactggcccgcccatatcaatacacatcattgcgccgataattgcgcctaacacaatcgcattcacttcgcccattgaagtaagccaattacttagctctttcataatttcagccactggtggattgatgaggtaaatcatcgtcaaaccaacaatcatcgaacctaagagcggtaaaattaaaatcggttttaatgaagtcagactcgctggcaatcgaataatcacatttagccctttcaccacatagcccgctaagaaaccagcaataataccgccaagaatccctgcacccgcttcacttgccagcatccctgcaatcaaaccaactgcaagtcctggacgatcagcgatagaaaatgcaacgtagccagcaaacacggcaatcattaacttgaacgccacaccactaccgatatttatcaacatatttggaagatcttgaaaaactcctgtattttcaattacattaaaactgaacataaaggaaatcgcgatcaacaatccaccagcaaccactaacggtaacatatgagaaacaccagtcattaagtgtttgtacacaccttttttctcacggctttcttctttcgttcccgcattatttccaccatcaaaaattttggcttctttaaatgctttatcaaattcttgctcagttttctttaaggctaagcctgttgaagtgcggtacattggtttacctttaaatttatctaaaggcacgtcaatatctgctgcaacaaataccaaatcagccgctgcgacttcttccacagtaatttcattgccagccccaacttgaccacgggtttcaacttttacattccaaccttgctttttcgcataggcttcaatcgcttcagccgacataaacgtatgtgcaacgccagttggacaagcagttaccgcaacaatattttttacaccagaaacacctgtaaaactcaccgcacttttcggtgcaacataatcagccccattggctaaagcatttgccagcgtgacttcaggagaaatcatggcgatagcttcgccgataataaagacttttttaccaactaaatcggggttatttggtaatacagaaccaaatacgagaacaagatctgcttcggctggtgttcctacaatagagacatttgctttttgtgcagctgctcgaaaaacttcatgtaataaataggctttcacatcgcctacattagctgattgggttaaaaataacttcatactatccttcaatcatcgttatttgtactttttctaaaatagggtcaagtaaactcaaatcactcacaccgacgttactctgagatacagcaaaagcggacacagccgtagcaaaagctaaagtttctgttttcgataaacctttttcaaaaccatagattaagcctgctaccattgaatcccctgctccaacggtactcacgacattttcacattgtgctggttcggctttgagcacgccttcattattaatccataaagaaccttttgcgcccattgaaataatcacgttttcaatgccttccgctttgagttgctgtgcagcggcaataatttcttcaagactatttaatggatgaccaacccaagcctcaagttctcgatgattgggttttactagccaaggtttcgcttttaatccagcggtaagcgcagcattgctactatcaagcaccactttaacgccagcttgatgaagctgattcaaccaatcagcaaacaattcaggagacacacctcgaggtaaactgccacaaactgcgacaatgtcataatttaaacaataagccaaagaatccgtcacaaattgttgccaaacttgtgggcttatttgataccccaagaaatttaaatctgtcacatccgcttcagtctcggtaatttttacattgatacgcgttttgccatcaacacggtggaatttatcttccaaaccgtgctgattaaacatttgctcaaaatcagctgaattatccttgcccaagaaaccgcctactgcaacattaacgcctaaatcttttagtacttttgcgacattaatgccttttccagcagggaataagcccaatgtttctaccgtatttacttcgccaagttgaatacgatttaaacgcccaactaaatcataggcggcatttaaggtaatggttacgacgcttgccatactattcccctaaacccgattcgatcacagcaccgattccgtcaatagcttgttgcgcttcttcgcccgtcgcaacaaaacgtaaacgagtccctttgactacgcctaatgccacaattttcatcaaacttttagcactgactaattgagaattacgatcaaggttttgaactgctacggaagcattatatttcttcacttcgtttaccaatattgcacttgggcgagcgtgcaaaccttgctcgtttttaatcacaaatacggcttcaatggcatttgctggcaaattatcatcttctgttaccgcaggtgtgtgaatttgatcgcccataatctcaatggtatcgggttcagacggtggcactgccgaaacattctctcccaagccattggctatcgctttgcccaatgattcaattgcttgttttgcatcttccccctctgccacaaaacgtaaacgatgtccttgtgttacaccaagcgcaacaatcttcatcaaactttttgcgctgacgacttcactttcacgagtaagattttgcatggttattttagaagtgaattttttcacttcattaaccaaatttgcacttgggcgtgcatgtaagccgtgttcattacgaattgtaaaagttcctacaacagcaccttctacagattgagtttcaacatcactcgatgaacccaaaagtgcggtcaaaatttctgttgaatttccattgagcaaggttgtttggacatcgtcatctaataaacgcaccaaagttggattaatttgatcaccgacggctgaaacggttatcacgccttttacggccttgccattgtggctaaaaattgttttagcacgactaaatgctaaggcatttttcacatttcctacgacagagtccgttacccataaccctttgccaagcggtaatgccgcattatttatcacttcagaaataaagcgattttctaccgcactttgcacctgtaattgccccgcattaatcgcaactaaagttaataaactttgggtatttacatctaaactgatattggcagcaggaatttcaaatggatcaattgtctcgcccattaaaatcgcgcaaaattcagccacatcagttatttttgctaattttgctgcggtatcttcatcactcaaaacgtgggtaagttgacgtaataaggacaaatgctcatcagatcgcgccgcaataccaatcacgacataagcaatatttccttcgccccattctatgccttgaggaaattgaaacacttgcacgcccgttttctttaccatcaaacgagtatccaaggtgccgtgaggaatagcgatgccattgcctaaaaaggtcgaggtttgcagctcgcgcgctaacattccttgcaagtaaccattttcaacattgcctgcttgaaccaatgcggacactgccatttcgatcgcttgttgtttatcaattgcattagcatttaaatgaatgttgctttccgaaagttctaacattcttgctccttaataatttaaaaagaaagctgcggatgaaacaaatcgaccagcagcttattgaaaaacaattatttagatgtacaggctttcagcagcgcttcactaccttgcacaatatattcatcattttctccgcgcgcttcgcctttttgtaaatcacgcatcgcatcataaataccttgagccatactttgcgaatccactttttcccaacaatttgcgctcaaacgtttaaggttcgcttgcaatgcttccgcatgtaacacgccgctataataggcatatacatcagaatcatggccgcctgtataaagtttatcctgaatttgtttcactggaactaaaatacggcctaaataccagtcattcgcaccacttgcaaaattatctacaaaaaaattttcattcacgcgacctttatatgtcgccacagtcgcttcataagcagctgcataagatttttgatcgattttatctttatctaaatcaatcacttttttatcgttccccataaatggaatatagttagtaaccgatgaccaagaagaacaacctgccaatattaacgtaaaaaataaaacagagatttttttaaacatagtcatacccgattaaagttaataaaacgccgccattatactgtctaaaggggattaagcaaggaagcctgtaaggcttatctaggcaaatgttaatttcgtataaaatcagtaaaatcagaccattgctcaatacgaaaagcacgaatatctcgtaccgactgagaaatccacgccaactgttttagtgcattcattgcctgaaagagattcgccatatcttcattcatgttgatatataaacttccttgtgttctaacaaaaccaaattttgctaagactgcgccaatgtctgtataagcctgttgaacgccctttggatgataatcttgagtgtcttttacaactaaaaaagcaatcgcgtacataattttccttattcagcttcgggatcttcaagcaggtgagataagcgataaatgtctttttcaccagattgtaacaatgtgatattcaccaacacatcaccatctggcaaaaattccgcaacctcgccaaccacataaggcacgccaaattgcccgaattgcttaatacagcctgttggaatttgttgtcttagttccatatttaacctcaaattttttatggttttataacataattttgtagagaaatggataaaaatttaccgcacttctactcctgctcttttactaaagacaccaaaatctgatcgattttaaagttttccgtatcaatcacttcaaacttgtattttccgtaaaccacagaatcggtttttttcgggattttacgtaacatatacatcataaaaccactgatagtttcgtagttttcttcatcgggaaaataagcaatatctaatactcgagttacctcttctaatggcgttgcgccatcaatcagccacgagttttcatcacggctcacaatatattcttcttcgttagaaaccaattcccccataacaatactcatcacatcatttagcgtaacaatacccactacaagagcatattcattcacaataatcgcaaaatcttcgccagtagatttaaacaattccaacacttcgtaaagagaaagcgtatcaggcacaaataaggctttacgtagtagtttgggatcagtcagcaccacattttcattctgcaaatacattgtgagcaaagtatgggattcgatataacctaagattttgtcgaggccattgtcacaaatcacaattttagaatgagaatcacgagaaagcgtatccatgacttcttggcgagaaaaagtgcggtctaaatatacgatgttttcacgggttgtcattgtggaagttaccgtacgggcttgcatatcgaaaatattttcgatcaaataatgctcttgagtttttaatacaccagcttctgcgcctgcttcaactacggcgaaaatatcttcagaggtcatgccatcttcacgcacagtagaaatgcgaaataagcggaaaaatacattagcaatagtatcaaaaaaccacacaagcggtttaaacacatacatactaaaattcataatacccacaacgctcaacgccaccatttcaggataagtaatagcaattcgttttggaataagatcagcaaataaaataaacaaacaagtcactaatataaaagcgattgtagaggcggttggcgcaatccaacttccttcaaaagaacgatttaaaatatctgcaatgtaaggacttagcgcactttcgccaattcccccacccaaaatcgccaccatattcaacaaaatttgaaccaccgtaataaaacgaccaggatgctcttgtaatttaagcacttgaagcggacgcacgtcgcctttatttgcaagagattgcaattttaacttacgaggactcgccagagaaatttcagcagaagaaacaactgcgctacttaaaattaaagccacaattgccaaaatagtatgaaataattccataatcattactcaaaaatataaaagaaaacgaccgcactttgcgaccgtttgggatattacttatcgctgtcaaaccagccgcgaataaattggatagacaaaaataatgtcgccagcaagaatacatataaaatccacgaaacaatcggattgcttggtgtgtcatcagcagtaatttctttaattgaggttgcattacgatattcatccaccatcgtaatacgccaaccatagtatttaatttgcacaagtttgttgtcattacccaaagcctgtgcttcagcctgtaaattggctgagccaaatttgaagtagaatgggaaaccccaacgtgtatcttcgttgcgatacaccataattttaccatcgtcattttgcgtattgatgtaatacacatcacgtgttgggccatcagctggattcgattttgtgatggggccatccttatcaacacgtttaacttctacgccagtaacacgtgtcacatcgtaatgaggaaatacataattcactacggaaaacataaaaccgtggaataaaaaaacaacaataaataagaaatatttaaaaaactttcgcatacttttcccttgttagaactgtgcatttattctacacgaattttaaataaacgctcgaaattttgtgtagtgatttgagcaaacgcctctgcagaaacgccctttaaggttgccacgtattcacatacttctctcgtatacgctggttgattttcttttcctctgtaaggcactggcgcaagataaggcgaatccgtttccaccaataagcgttccattggtacataacgaataacctcacgaatcgcttcagcatttttaaaggtgacaatgccagaacaagaaatgtaaaatcctaaatccaacgcttttttcgnaaattccatagtttccgtaaaacaatgaataacgccaccgcacttttcagcacggtgttggcgtaacattgcaatggtgtcatcgcctgcagaacgtgtatgaataatcacaggcttatctaattggtttgcaatatcgatttggctaccaaacaccgcttgttgcgccgctttattgtccgcactgtaataataatctaagccaatttcgccaatagcaatcactttaggatcttgcgctaaacgcaataaacgttctgcgtcataaggttcttcttcaaaatcaagtgggtgaacaccacaagcaagcgagacattattaaattcccgtaaagagtcataagcctgctcaaaacggcttaaggttacaccaatcgcgagcaaatgtttcacatcacgtgcgtgcgctttttccaccacatccgagatatttttatgtaaattttcataatccaacgcatctaaatggcagtgggagtcaacaatgaacataattatttttccttatgcctaaggcttgaacgccatagacgatatatctttaatttattgcgtttcaaatacttctgtgactaatcgtgtcaagccatccaatagcattaattcaacattcacaccattaattgtaagcaaatctgaccgcactttttgcataattttaatggcttgtaataaaccaagggcagtttgctcgtcgctgaattgttcgataccacggccaagatcagccacttgtcgatgactatcaatttcaagtttatgttttaaacaatcagaaagaaaagccaaaatccaatccacttgctgaacatagcgttctttatcaaacaacggaagcaattccaatggcgaacgtcggcgatagaacacccaaaattgacgtaagaagtttttacgctgttcaataaatccttcttgtaacgtttctaatgctaaaagcggacgcccaagattcatcgcaagtgcggtcaaaatttcctgattttctaccgcactttttgattttaaccattcaaaagcaatttcttcattaggcacggaaagattccacacttggcatcgactgtaaatagttgctaacaaacttgccgaactatccgcttgaagtaaaaaataagtatttggacgaggctcttccaatgttttcaataatgcattagcagccgcttccgttaaacgttccgccccttgcacatacaccactttattgccgttttgttgtgcgtgctgcgcaaccatttcattaatgtcgcgtacttgatcaacgccaatatccttaccgttaatggggcttaattcgtgataatctggatggctatgggcttgcattaaatgacaagaatggcattgaccacaaggtttatcgccttgagctacacacattattttctgtgcaagtgcattaaataaactctctacgcctaaaccagaatcagctttaatcagcacagcatgatgccccaacccttcgtcaaaggtttgagcaatttgatgataaattggcattagccaagggtaaagtgcggtcatttttcgtttgatttccaccaattttttaccgcactttcaatatcagcttgaacaagttcaatactctgctctgcattaatcaccactgctttgggattatcttttactaattctaaatagcgtgctcgagtacgatggaaaaaatctaaatccatttgctcaatacgatctaactcgccacgtccacgagctcgcgctaaaccgacgctcggatctatatccaaataaattgtgagatctggctcaaaattacctaatacggtttctttcaaggtgagcataaaatgcgggtctaattgacgtccaccaccctgatacgcctgagatgacatatcgtgacgatcgcccactacccatttcccttgcattaaagcaggtttaatcacattttccaccaactgaatacgagccgcataaagcattaataactctgctttatctgtcacgggttcttcggtttcatgtttgatgagatgacgtaatttctcagccagtggcgttccaccaggctcgcgcgtaaacacaacatcttgaataccaagttcatgcaaaactcgcactacagactgatgagcggagcttttccccgcaccttctaagccctcaatgacaataaactttcctttcatattttcttccgcacttttatttggcatttttctgactgcgataccaacgtaaatattcttgcaccgctttgttatgttcattcaaatttcgggtaaatttatgcccaccagaaccatctgctacaaaataataaaaatctgttttttcagggttcgcaacagcctgtaacgaactttcacttggcatagcaataggcgttggcggcaatccatcaatcacatacgtattataaggcgtcttggtttctaaatcttttttgcgaatattcccattgtaattttcgcccataccataaattaccgttggatccgtttgtaatttcatttttgcttttaaacggttgataaatacagatgccacttttgccctctcattagcaatacccgtttctttttccacgatagaagccaaaatcaacatttcataaggattcgctaaaggtaaatcctcgtcacgctcgttccaagccttatttaacgcctttttcattcgctcagccgatcgcttaagtagctctaagtctgtcgatttaggcgtatagttataagtatcaggataaagccaaccttccacattttttagttcaagattttgaccaatatcaggcaaatcaagtaatgcgaaaatttcttcgttactcttatctttcaaggtttgcaccaagtgcggtgcattttcaagatcttttcgccaatctttaaaggtttttccttcaatccattttacattgaactgcacttctttaccggaattgagcaaatccagtaaatcttgcacagttttaacattctcaagagaataagtccctgcttttattttatttaactcaggtttcaacttcagcaaataaggtaataatttcccatcagcaattaacttttcttgctcaaaaagtgtggctaattttgaacttgttgtgccacgttcaatcgttaaaagttcatctgcctgcacatttactggtgtttttacaaattcagtcattttgtaataagaaaaactcgccacgcccgctaaaatcaaaattaaaagtaaaatcgcaattaaaaatttcttcataagctataagaaagagaaaataaaaaacaacaaaaggggcaattaagcccctttatttttgatactttgttatttattaaaatactgaatattcgctcttttacgcaatgctttaacccaatcgttcgtcgcatcttgtaattgagtatttactaaacgttcatatgctttttgtgtgtaggcttctgctgtaagatcgccatcacgtacgccagttacttccaaaatatgccaaccaaactcagttttaaatggtgcagaaatcacaccttgtttacttttcacgacggtttgtgcaaactgtggtgcataagtttctgggaacgcataacctaaactaccgccattcgcacccgataaataatctttagaatattttaatgcggcatcagcgaaagttgttttacctgcaataatatcagaacgaattttagctaattgtttttttgcttgagcatcatttaacaatggattaagttttaacaaaatgtgacgcacttcgtattctttacctgtaactttttgtgcagtgccttgtgattttgcctcatccaacattttttgaccaagtgcgacaacttcttcacgcgttacatcaatgctttcttgaatagctttgttacgtacagcccccatcaccatttgattggcaatttgctgacggaatgtatttaatgaaatgccttgataatctaacgcatccaaaaattgaccataagttaaaccatttctagctgcggtatcttccacaatatgatcaatttcacgcggatcaattttgactcccgattcttgaactgctttttgcaccaaaatatcatcaataattttatcaatcgcactttggcgatcaccttttttacccatattggcacgcacttgactttctaaaacaggaataccatccactgttgctacgacacgttcctccgcttgtgccatagaagtaaaagcaacacaacctaaagtagccaataaaaaagatcttaaaacaaattttttcattttcatctcatccaaaaaagagtcaataacgttggttagagtaacaattctattgaaggttcacaatagataagatttatttccctagaatagcaacttcgtaacagccatcttgtttttcagtgcgaacttgcacaagttcatcacggcttgttggcacatttttacctacgtaatcagcacgaatgggtaattcacgatgaccacgatcaacaaaaatcactaattcaatttttgcagcacgaccaaaatcagtaagcgcatccattgccgctcgaatggttcgaccagtaaacaacacatcatcaaccaaaatgacggttttatcttgaatattcaaatattgtgatgaaccactataaactggcattttatcttcctgatcaaccaaagttaaatcatctcgataaaaggtaatatccagttccattgaaggtaaatttatactacttaactcttcaactcgacgttgtaataattctgcaatttccgcgccacgtcgtttaatcccaacaatcacaagatcatctaaggtttgatgtttttcaataatttcgtgagaaatacgcgaaattgtgcgaagaaaacgatcatgatcaataataattttttccatttttcccagctttatcaatagtatttcaatgcacaaagtataaagaaaatacgcctaaaaagcgacggcatttgcaccatttttcttgttcgttatactatccaaaacattccatcaaaggaaaccaaattatgcgctactccattcaagattttattcaactcatcgcccaacttcgcaatccaaatggcggatgcccttgggatttaaaacaaaattatgaatctatgatttcttgtttaacggaagaaacttacgaagtaattgaagccattgagaaaaaagacataccaaatttacgcgaagaattaggggatttattgttgcaagtcgttttcttcagtcagcttgctagggaagataaatactttgcttttgacgatgtattgcaagatgttgctgaaaaaattgtacgccgtcatcctcatgtgtttggtgatgcaaaagcgggggacgaaacagaagctctttcccgttggaatgaaatgaaagcgaaagaaaaacaaggtaaaagtgaagaaacctctattttagataatgtgcctcgtgctttgccttctcttacgcgagcggcaaaattacaaaaacgttgttcaaaagtagggtttgattgggaagaaatttcacccgtatttgacaaagtgcgggaagaattagaagaagttcaagctgaaattaaccgcacttcgattgaacaaaataaagtggaagaggaaatcggcgatttattgttcgcaaccgtcaatcttgctcgccacttaaaatgtgatcctgaagatgcattgcggaaagcaaatttaaaatttgaacgtcgttttcgagcagtagagcaagcggttcaacaacaaggtaagcaagtgaataatgtgccacttattgaattagatttgttatgggatgaagtgaaaaaacaagaaaactaattgaaaagtgcggtaaaaatttctctcattttttaccgcactttcttcgttaaagttgctgaatatccagtgccatttggtctaacatttcataacgtttacgatacatagaacgttttttacttgcgatatcttctaattgtttgcgttcaatatgcaaaggtaattgccaatagttatggcgatattctccttggttttcttgccaaaattcatcgtaattaaacaaaatcttactgcgcgcagaaagacgatattttccttgtgctttgtgcggaatgcccactaactcacattgccatttttcagcaagcattttgaacccattaaccaacataaacattggtcgcataccgtgtaatgcttttgtagcctgtttcacaagttcttgcgcattgtcgcttgaggggccttgaatcgaggcgataagcaatttattcgggcttaaaaaagtgaaagacgaatcatatactcgttcgttattttgattgcgaatattaatagaaaaatatccttcaaagggatcgatatgattaatactcaacgataaacgcaaatcctcagttaattgggttagcacgatatgttgttgatctaataattgctgacaaagcgaacgtcccattttttcttctgccaaacgtaaattctccgtaatcgccgttaaacgttctgaagcagaaaaacgtttatcgcaaaaggtcgtcagaattgtattagtacgataataatcttgtgtaaataaagactgccattgcgtttctgtattaagaaaatccactaattggctacattgcttttgatataaccatttatagccataatagcgtaatttttcccgcacttgtttaagaaaagggcgatccttagaataaggatacatttgaacgtaagtggggaaaataaaatgatttttcgtggacataactcaatattttgtgaaatttaataaaatttttcattattttagccattatcacttcatttgccaaaattcttttttgtttaaaacccactttataactcagattttgttataatcttttccttgaattcctttttccctaccccaatatttacccaaattatcggaacgaaattataagagagaccaattatggcgaagaatacccaacgtacaatgcccgtattgccattacgcgatgttgtcgtttttccttatatggtgatgccactttttgtagggcgcgcaaaatcaattaatgcccttgaagaagcgatgaacgatgacaaacagattcttttggtatcccaaagagaagctgatttggaagaacctacccctgaagatttatttgatgtgggtaccattgctaacattattcagttattaaaattacctgatgacacagtaaaagtgctagttgaaggtcaaaatcgcgcgaaaattaacagtcttgaagacggcgaaaagtgcttttccgcccaaattacccctatcgaaaccacttatggcgatgaaaaagagttagtggtggcaaaaagtgcggtactttctgagtttgaaaattatcttaccctcaacaaaaaagtgcctacagatattctcaatgcccttcaacgtattgatgatgttgatcgcttagctgacacaatggctgcccatctccctgtaagcattcgccataaacaaaatgcgttagaactcgctaatgtgcaagaacgtttagaatatttgcttggtatgatggaatcagaggctgatattctccaagtggaaaaacggattcgcggtcgtgtcaaaaaacaaatggagaaaagccagcgtaactattatttgaacgagcaaattaaagccattcgtaaagaaatggatggtggcgaaaatgaagataccattgatgaagttgaacaactgcatcaaaaggtagaagcggcaggcatgccagctgatgtacgcgacaaagtagaaaatgaattacaaaaacttaaaatgatgtcagccatgtcttctgaagcaacggtaatacgcagttatattgaatggatgatccaagtgccttggcatcaacgttctaaagtgaaaaaagacattgttaaagcacagcaagttttagataccgatcactatggtttagatcgcgtaaaagaacgcattcttgaatatttagcagtacaagcgcgtttaaacaaagtgaaaggcccgattctttgtttagttggccctccaggtgtaggtaaaacttctcttggtcagtctattgccaatgctactggtcgtaaatatgtacgtatggcattaggcggcgtgcgtgatgaagcagaaatccgtggtcaccgtaaaacctatattggtgcattgccaggtaaattaattcaaaagatggcaaaagtgggcgtaaaaaatccattattcttgcttgatgaaatcgacaaaatggcatccgatatgcgaggtgatccagcatcagcattgcttgaagtattagatcccgagcaaaacaccacatttaacgatcactatttagaagtggattatgatctttctgatgtgatgtttgtggcaacatcaaactctatgaatattccaggcccattattggatcgtatggaagttattcgtctttctggttatacagaagatgaaaaacttaatatcgcaatgcgccatttattagcaaaacaaattgaacgtaatggtttgaagaaaggcgaacttaccgtagaagaaagtgcaattttagatattatccgctattacacacgtgaagcgggcgtacgtggattagaacgtgaaatttcaaaaatctgccgtaaagccgtgaaaaatttattagtaaatccaaaacttaaatctatcacggtaaattcagataatctgcacgattatcttggcgtaaaacgttttgaatttggtaaagctgacacgcaaaaccgcattggtgaagtgactggtttagcttggacagaagtgggcggcgatttactcactattgaaactgcctctgttgtgggcaaaggaaaactttctttcactggttcattaggcgatgtgatgaaagaatccattcaagcggcaatgaccgttgtgcgtgctcgtgcggataaactgggtatcaatgctgaattccacgaaaaacgtgacattcacattcacgtgccagatggtgcaacaccaaaagatggcccaagtgcaggtattgcaatgtgtactgcattaatttcttgtttaacaggtaatcctgtgcgtgctgatgtggcaatgacgggagaaatcagtttacgtggtaaagtattaccaatcggtggattaaaagaaaaacttcttgcggcacatcgtggtggaattaaaaccgtattaatcccaaaagaaaacgttaaagatcttgaagaaattccagagaacgtaaaacaaaatcttgcaattcatgcggtagaaaccattgatgaagtgcttggttttgcattggaaaatccaccagagggcattgagtttgttaaagtggaggctaaacctaaagcaccacgccgtaaagtgacgagtaaatcagaaagagcggtcaattaattgaatgttttagggcttgtgaaaacaagccttttattgattttagagatgataatttcatctttacacaaggttaatttatacttttccaaattgaaaacttgttaataacacaatgccaaaacttcctccactttccctttatatacacattccatggtgcgttcaaaaatgcccttattgtgattttaattcgcacgcacaaaaaagcgatataccagaacaagactatatttatcatcttctgcaagatttgcaggctgatttgcaacgctttaaagattctattcaacaacgaaaactccattcaatttttattggtggcggtacaccaagtttgttctcggcagaaagcattgcgtatctcttaaaagaaataaaaaaacagattgattttgaagataatattgaaatcacattagaagctaatcctggcacggtagaagctgaacgttttaaaggttatgtatccgcaggcattatgcgaatttctatgggaattcaaagtttcaatgatgataaattacaacgtcttgggcggattcataatgcagcagaagcaaaaagtgcggtcaatttagcgaaagtttctgggctaaaaagttttaatttggatttaatgcacggtttgcctaaccaaacgttggaagaagccttagatgatcttcgtcaagcaattgagctatctcctccccatatttcttggtatcagctgactattgaaccaaatacgatgtttgcttatcgcccacctaaattaccagatgatgacgcactttgggacatttttgagcaaggtcaccaacttttaacgatggcaggctaccagcaatatgaaacctcagcttacgcaaaagcaggttttcaatgtaaacataatttgaattattggcgatttggggattatttagccattggctgtggcgcacacgggaaattgacgtttccgactggcgagattactcgcttttctaaaaccaagcacccgaaaggttatttgcgtggcgaatatctttacgaagaaaaaaacgtgccaaaaattgaccgcccttttgagttttttatgaatcgctttcgtttgttagaagcggtacccaaacaagaatttgaagattacacaggcttgtcgcaaagtgcggtgaaaaatcaaattgattttgccattcaacaaaactatattgtggaaaacgctgattcttggcaaatcactgaacacggcaagttatttctcaatgaacttttggaattatttttaacggaagaatagcctaatcgtgaaataacctagtcgtgaaataacattgcttgagaaaaacgcctgttaaaaattacacttgtttattaaatactctcgtaataaagtaacacaatcgtttacttattaagataaggaaaagaaatgaatcaattagaaatgaaaaaactcgccgcacaagctgcattacaatatgtaaaagcagatacgattgttggggtgggaagtggctccacagtgaactgctttattgaagctttaggtacaatcaaagataaaattcaaggtgccgttgcggcttcaaaagaatcagaagaattattacgtaagcaaggtatcgaagtatttaatgcaaatgatgtctctagcttagatatttatgtggatggtgcggatgaaatcaatccacaaaaaatgatgattaaaggcggcggcgcagcactcactcgtgaaaaaatagtcgctgcattagcgaaaaaatttatttgtattgtggattcaagtaagcaagtggatgtgttgggttcaactttcccattaccagttgaagtgattcctatggcacgctcacaagtaggcagaaaattagccgcacttggtggctcacctgaatatcgtgaaggggtggtgactgacaacggcaatgtgattttagatgtacacaacttcagtattttaaatccagtcgaaattgaaaaagaattaaacaacgttgcaggtgtcgtcactaatgggatattcgcgttacgtggtgcagatgttgtgatcgtcgggacgcctgagggtgccaaagttattgactaattcataataaaaatcataaggaagcaaacatgacaaacaaagtctctctagacaaatcaaaaatcaaatttgtattgtttgaaggtgtgcatcaaagcgcacttgatacgctccatgcggcaggctataccaatattgattactataaaaaagcactagatggcgatgaattaaaagaagccattaaagatgtacactttatcggcttgcgttctcgcacccatttaacggcagaaatgattgaggccgcacccaaattaatcgctgtgggatgtttctgtattggcaccaaccaagtggatttaaatgcagcaaaagcgcgtggaattcctgtatttaatgccccattctcaaacactcgctccgtcgcagaacttgtattaggcgagattttattacttatgcgcaatgtgccacaggctaatgccgaagtacatcgtggtgtctggaataaatccgcgactggctctcatgaagtgcgggggaaaaaattaggcattattggttacggtcacattggttcacaattaagtattattgctgaatcattagggatggatgtgtatttctacgatattgaaaacaaacttccactcggtaatgccaaacaggttcgtagccttgaagaattactcagttcttgcgatgtggtttcattacatgtgccagaactgccatctaccaaaaacttaatgaacgtagcacgtatcgcacaattaaaacaaggggcaattttgatcaatgctgcgcgtggcacagtggtagatattgacgctctcgctcaagccttaaaagatgggaaacttcagggtgccgcaattgatgtattccccgttgagcccgcttcaattaatgaagaatttatctcgccgttacgtgaatttgataatgtgattttaacgccacatatcggcggctcaacagcggaagcacaagaaaatatcggttttgaagtggcaggcaaatttgtcaaatattcagacaacggatcaaccctttcttcggtaaacttcccagaggtctctttaccagaacacgagggaacaaaacgcttattgcatattcacgaaaatcgtcctggtatattgaacaaactgaaccaaattttcgtcgaagctaacctcaatattgcagcgcaatatttacaaactgacccgaaaattggttatgttgtcgtagatgtagaaacgaatgatgcatcgccattactgacgaaattgaaggaaatagatggcacaattcgtgctcgtgtactatactaaatagaaaaaagatcaggttaatgcctgatctttttttgctttcttattcagtaatcgaataaggtaactgcactcgctctaacaatatttcactattcagcaacctaaattgttgctctgaatcaatgtcgttattcatcacaacttgcaaccataaaacaccgtctaaattgaccgcacttgtaatcgtgccagtcttacgccaattagcttcaagctgcatttcaatttcactgccaatttccgcttcctgctgggtttgcactttaaaaataaacattgcgcgtttattcgcaccacgatatttcgcacgtgccacggtttcttgcccaatataacaacctttggtaaaagaaatggcttgctcaatagcctgtaaatttagggcttgtgggataaattcattttgcgtttgaggacttaaatttggcaatcctgcttgaatatcagctacttcccaaattttttcatcgccattaaaattcacgggcaattcagtttcatttaataaaattgaacgtttttcatcaatttctaatgaaaagttcggtgtaatttttccacatttttcacctattacgccaatgatttgccaatcacgtaaatcaaaactaactttggaaaataccgcatattttttcaaagcatctagaccgcttggcaaaatatctttcttaacgagtaaaaagaattgttcactacttactttaaacaaacgataaattgcattcattttaccttttgggtcgcagtgagctgtaagtgtcgttgcgccacttgctaatcgcacaacatcagaagttaattgcccttgcaaatatttttctgcatccgcaccctgtacttcaatcagctgatattgagtaagagaaataaattgagacattctgttttcctattctaaattctgaatttgctcacgcatttgttcaataagcacttttagctccaccgcagaagccgtgatatctgcattaatggatttagacgcaagggtattggattcccgattcaattcttgcatcataaaatctaatttacgtccaactgcaccgccttttttcaaaatattcgtggtttctttcacgtgcatttgtaaacgatctagctcttccgccacatcaatgcgttgagcgagtaaaatcatttcttgttccacacgttgcggatcaagattaagttgagcatcttcaaaacgttgcaataaacgttcacgctgccattgtaaaactgctggcatttgtgaccgcactttatccgtttccactgcaatggaatctaaacgttgttgaataatatcgttcagtttttccccctcacgaccacgcattgcaataaaatctgtcagtaaatcatcaaaggctgtcaataaatcttgactaatcgcatctaaatcttgctcttgcgcttccactacgccggggtaacgcaacacgtctgtcaaattaatttccccttctccagcctgagctttaatccattgcaaagattgaattacttgattcgcaagttctttatttaaattcaattctgcatttgcttgtttttttgtttcaatgcgtagagaacattcaattttaccgcgagtaagattttgacgaagtttctcacgcaacgtgttttctaatccgcgaaattgctcgggcaaacggaaaaagttttctaaataacgttgattaacggaacgaatttcccataccgcatcaccccaatcttttttcacttcaaggcgtgcaaaggcagtcatactgtaaatcataagctctcctattttctcttagctttgtcttagttgattcgctaagtattgtaacgagatgaacacagaaagggaaaagaaaattaacacaataaaaatctggaaaattatacctcttaagtaaacatttttgataaattttaacgatagtaaaaatgtactaaaaacacaatttttttcaaaaaaattgctttttttaattttaaagtgtatttttaaggcaatataagatctaataacatttgagcgagcatatacaatatgaattttatctgcacttaccatcatcaccacacctgattatctttcaggcgtgattgtatgtttggaagataataaaatatcttccgagtgtaataaaaatcagtgtaaaagcaataaatacccctcggaaggcaattttcgaggggttttcttttatctcaactttaaaataggaaaaacattatgacaaacacaacaatgcaaccaaaccgccttcgtattgctttgcaaaaaaaagggcgtttaagccaagattgtgccatattacttaaacaatgtggcgtgaaaattaattggaatgaacaacgtttaatcgcttatgcggaaaatttgccgattgaaattcttcgcgtacgtgatgatgatattcctggattgatttttgatggcgtagtggatcttgggattattggcgaaaatgtgttagaagaggaagagcttggtcgccgtgcagcaaatgaaacagttacatacaaaaaacttcgccaacttgattttggtgattgtcgtctatcacttgcggttgatcgcgattgtcattatgagaatgtgaaagatcttgctaataggcgtattgcaacttcttacccgcatttgctcaaacgttatatgaatgagaatggggtgtcgtttaaaagttgtttattaaatggttcagtagaagtcgcacctagtgcgggtattgcttatgcgatttgcgatttagtatcatcaggggcaacgcttgaagcaaatggcttaaaagaagtggacgtgatttatcgttctaaagcttgtttaattcagcgtgctgaaccgcttgaatcaactaaacaagctcttgtggataaactactcactcgtattcaaggtgtgcagcaggcagcagaaagtaaatatattatgctccacgctccgaaagaaaaacttgaaaaaatcaccgcgcttttacctggcgttgaaaatccgaccattttaccattagccagtgatacaactcgggtagcaatgcacgtagtgagccaagaaaatttattttgggaaacaatggaacagttaaaagaggcaggagctagttcaattttagtgttaccaattgagaagatgatggagtaaatgtagtgcgagctttgactcgccatttaaataatcaatatctcaaaatgctgggttatcatccattttacggatacaaaggaaaataaacaatgcaaacaattatttggaatcatttatcagaaactgaaaaacgcaaagtcattatgcgtccagtccaacaaaatgggaaaaacattcagcaggcagttaatgccattcgtgaaaatgtggcatacaatggcgatcgggcattatttgaactctgtgaaaaatttgatggcgtgaagttagataaactcattgtttcggcagatgaaattcaagcggcaagtagtcggatttctgtaaaacttcgcaatgcgattgagcaagccaaaacgaacattgaagcctttcacaaagcacagcaaaatcaggaaattgacctagagatccaagaaggcgtgcgttgccaagttgtgactcgtccaatttcttgtgtagggctttatattccgggtggttcagcaccgttgttttccaccgtattgatgttagctattcctgctaaaattgcaggttgtaaaaaaatcgtgctttgttcaccgccaccgatctcagatgaaattctctacactgctcatctttgcggtgtggaaactatctacgctataggtggtgctcaagcagtttttgcgatggctcaaggcacggaaagcgtggcgaaagtagataaaattttcggacctggaaacgcatttgtgacagaagcaaaacgtcaggtagcacaaaatagtacggcgattgatatgcctgcgggaccttcagaagtgttagtaattgcagatgaatcggcagatcctgaatttgtggcaagcgatttactctctcaagcggaacatggggcagatagccaagtgattttggtggcgacctgtgaaactctggcaaaagagaccgcacttgcgattgaacgccaacttgctctattacctcgtgctgaaaccgttcgaaaagcgttaaaccacagccgtatttttatagcagaaagccttgaacaagcggtagaaattagcaatgaatatgcccctgaacatttaattgtgcaaacaaaaaacgcccgtaaattattaccatatttagataacgcaggctcaattttcttaggtgcatattcgcctgaaagtatgggcgattatgccagtggcacaaaccacgttttgcctacttatggttacaccaaaacttattctagtctaggattagctgattttagtaagcgaatgacagtacaagaactcacaccaaaaggttttaaaaaccttgctgaaacggtggaagtgatggcagaagctgagcaattggcagcacataaaatggcagtaagtgtaagattggcgaaactcaatatctaagatattaattatagatctaagcacgacacgtaagcagtcaaattttcatacaacaatacgaaatatgtatgaatgattacaattcgcacattttacaatggaagaaaacaataatgacaatcacaactttatcccgacaaaatatacaagccttaacgccatatcaatccgctcgaaaactcggcggcaatggtacgatttggctgaatgcaaatgaatatccaacttcgcctgaatttcagctttcgggtaaggatttaaaccgctaccccgaacctcagcctcaaagagtggtacaggcttatgcgaattatgcgggcgtttcaactgaaaatgtactcgttactcgtggcggtgatgaaggcattgaattgataatccacactttttgcgaacccaaacaagatgccattttattctgtcctccgacttacggaatgtatgcagtgagtgctgaaacggcaggtgtgctaagtaagaccgtgcctttaactgacgattttcagcttaatttgccagaaatcaaaaatcatcttaatgatgtaaaagtagtctttgtatgcagcccaaataatccgacaggtaatttgctcaagcaatcagatatactcgatcttttgcaaatcacggcaggcaaagcgattgtggtggtggacgaagcctatattgagttctgtcctgaagcaagcgttattaatttgcttaaaaattatccgcacttagcaattatccgcacgctctctaaagcctttgctttagctggattgcgttgtggttttgtgttagcaaaccctgagctaattgacatcttaagtaaggtaatcgctccatatcctatccctgtgccgagtgctgatcttgcggaacaagcgttaagaccttcgaacatcgccactgttcaagctctcacacaagaacttctttccaatcgtcaatggcttgctaaagctcttttagttttacatcaagtggaaaaagtgtatgaaagtgaagctaattatctgttgatcaaatgtcaaaacgggcaagctgtgtttaaggcattgtgggaacaaggaattattttaagagaccagaataagacattgcatttacaaaattgtattcgcattactgtgggaacaaggaatgagtgtgagaaagttgttgaagcaattaaggaggtaaaatgaaccacctcctatttaagtcacagagcgattcgagattatttagttttatactgtttgtataaagcaaatgataaacctcataccattcatataacatacacggagaaaaatatgcaacctactctttttatcgaccgagacggcacattaattgatgaaccaaaaactgatttccaaattgacagtttagagaaactaaaattagaaccgaaagtgattcccgcactcctcagactgaaagcgaaataccgttttgtgatagtttctaatcaagatgggcttggtacggatgcttttccgcaaacagattttgataagccccacaatgtaatgatggcattatttgaatctcagggcattacctttgatgaagtactcatttgcccgcataagcccgaagaaaattgtctatgtcgcaaaccaaaaattaagttgcttgatcactatattcgtaaaaatttattcgatattgaccgctcttttgtcattggtgaccgagagaccgatgtgcaattagcagaaaatctaggtattcgagctattcaatacgatccacagaaaatgaattgggatctgattgcagaaaaattgttgggggaaacggtcacaaactgtggcaaacgtccgccacgttttgcagaagtaattcgtcaaactaaagagaccgatattaaagtgcaggtttggctagatgaagctggtgtaaatgaaatcaaaaccggcgttggtttttttgaccatatgctcgatcaaatcgccacacacggtgggtttagaatgaacgtgcagtgtaaaggcgatttatggattgacgaacatcacacggtggaggacaccgctctcgcccttggacaagcactgaaacaagccgttggtgacaaacgtggtattgcccgtttcggctttgtgcttccaatggacgaatgtaaagcagaatgtgctttagatttatcgggcagaccttggatcaaattcaatgcctgctttaaacgcgataaagtgggcgattttagtacggaactcactgaacatttctttcaatctttggcattttcaatgcttgccacgcttcatttaaatgtcacaggtaataacgatcatcataaaatagagagcttatttaaagcctttgggagaacattaagacaggcgattcggattgaaggaaatgaaatgccaagttcaaaaggagttttatagttgaaagagcggttaatttttgtcgtatttttgcaaaattcgaccgattgtaaaaggataaaaaaatgataaacatcacgattatagacacaggttgtgccaacctttcttctgtaaaattcgcctttgaccgattaggttacaataccgagatcacttttgatctcaataaaatcaaatctgccgataagctgattttacctggcgtaggcactgcaaatgcagcaatgtataatttacaagaacgtcaattgatcgagaccattcaaaatctaacacaaccagtgctaggaatttgtttgggtatgcagttaatgaccgaattttccgaagagggtaatgtgccgaccttaaacctaataagcggaaaaactaatcgaattcccgatacgggtttaccgttacctcaaatgggatggaatcgcgtgcaatttgtaaaaaactgtccgttatttgatggtattgtgcaaaatagtcacttctattttgtgcatagttatgcagttagcccgaatgaacattcggtggcaataagcaattatggtgtgaatttttctgctgcgatagcgaaagagaatttttacggtgtacaatttcatcctgaacgttcgggtaaaaatggtgcgttgttgctaaaaaattttgtggaaaaagtaccgttttaatcactagatcatatagtcatacaggatcaaacacaatgaaacaatctattattattcctgctcttgatcttatcaatggtcaagttgtgcggttacaccaaggcgattatgccaagcaaactacctattctgacaatccaattaagcaatttgataattatgtacgtcaaggagcaaaacaactacatctagtcgatttaacgggagcgaaaaatccccagtcaagacaaaccgcacttattggaaaaatcgttgaagcaacacaatgtaaagtacaagtgggaggaggcattcgtacagagcaagatgtggcagatttattggctgtgggtgcgaatcgcgtggtgattggttcaaccgccgtaactcatcgttcaatggtgaaaaactggttcatcaaatatggtgcggaaaaatttgttctagcattagacgtgaatattaatgcaagcggtcagaaaatcgttgcgattagcggttggcaggaagaaagtggtgtactattagaaacgttgatcgaagatttccaaaccgttggcttacaacaagttttatgtaccgatatttcacgcgatggcaccttgacaggttcaaatattggactttatcaagaaatttgtgagaaatatccacctattcagtttcaatcttctggagggattggttcactggctgatattgaggctctaaaaggcacaggtgtgtcaggtgtaattgtaggtcgagctttattagaaggaaaatttacgctttcggaggcaatcaaatgttggcaaaacggataattccttgtttggatgtacgtgatggacaggtggtaaaaggggtacaattccgtaaccacgaaattattggcgatattgtgccacttgctcaacgctatgcgcaagaaggagctgatgaattggtattttatgatattacggcttcatcagacggtcgtaccgtggataaaagttgggtagaacgaatcgctcaggtaattgatattccgttttgcgtagcaggtgggattaaaaccattgaagatgcggaaaaattgtttgcatttggggcggataaaatttcgattaattcccctgctctcgctgatccaacgctcatttctcgcttagcagatcgttttggcgtacaagcgattgtagtaggtattgatagttggtttgaacaggaaacaggtaagtattgggtaaaccaatatacaggcgatgaaacacgtacccgacaaactcattggcagttgttagattgggtaaaagaagtacaacaatgcggtgcaggagaaatcgtgctaaatatgatgaatcaagatggtttacgaaacgggtacgatttagcccagctcaagctggtgcgaggagtatgtagagtacctctaattgcatctggcggtgcgggtaaaatggtacattttcgtgatgcttttattgaagcaaaagtagatggggcattagctgccagcgtattccataaacagattattgaaattggcgagttaaaatcctaccttgtgcaatcagccatcgagattcggagtgaataatgaatattactaaaatagactggcaaaaagttaatggtcttcttcctgttattattcaaaatataagtactcgtgaggtactaatgcttggctatatgaatgaagaagcccttacaaaaaccatcaaagaacgtaaagtaactttcttctctcgtaccaaacaacgattatggacaaaaggagaaatctcgggcaattttttaaatgtggaagaaatgagcttagattgcgataacgacactttgctcattttagttgatcccattggggcaacttgccacacaggtgaatacagctgcttccatcaatttacctctccacaatcagagaacaagaagcaacaatttgcaaattgggcgtggtttataaaattagaacaacatttaaaagaaaagaaaaatgcagatccttctaattcttatactgcaacattacacgcaaaaggtaccaaaaaaatcgcccaaaaagtgggggaagaaggtgtggaaactgccttggctgcggtcgcacaagataaagcggaagtcatttctgaagctacagatttggtctatcacttaaccgtattattacacaatcaagatcttcagtggtacgaaattatcgcaaaactacaagaacgccatcaagggattggattacatccagaaggaggaaataaataagaaaattgtcaggcaatattaagtgagcaattagaagatttgtttgggcaattcaatatcatcgtaaaatacagtgaaactatggtaattaaatgtattgataaacaacaaaatttaggaaatatcattttattccttcttcttaagcaacaatatagcaaggaagatagtaaaaaattcacaatttataaattttatttacagactgtaaattatacaatacaattatcgtaaattttttattacatcataaggaaacaaaaatgaacaaaactgtaggcagcacacttcttgttgctggtacgatgattggcgcgggaatgttggctatgccactcacttccgctggcattggcttcggctttactttagtcttgttattggggctttgggcattattaacttttagcgcacttttattcgttgaactctatcaaactgcggaaagtgatgcaggtatcggcacacttgcagaacaatattttggtaaaacaggacgcattattgccacagccgtgctaattattttcttatacgcattaattgccgcttatatcagcggtggcggttcactactaaaagatttattaccagaaagttttggcgataaagttagcgtcttattatttaccgtgattttcggttcatttattgtcatcggcacacatagcgtagataaaattaatcgcgtgttatttttcgttatgcttgctgcctttgccgtggtgttaagcttaatgttgccagaaatcaaatttgataacttaatggcgacgccaattgataaggctttaattatctctgcaagccctgtatttttcacggcatttggtttccacggttccattccaagtttaaataaatacttagatggcaatgtaaaagcattgcgcttctctattttggtcggctctgccataacactttgtgcttatattctatggcaactatccacgcacggcttgcttacacaaaatgaatttttacaaatcttaaaagaagatgcgactttaaatggcttagtaaaagcaaccttcgccatcactggaagcaatgtgatcgcaagtgcggtaaaattattttctacattagcacttatcacttctttcttaggtgtgggattaggattattagaatgtattgaagatttactaaaacgttcatttaacgttacagcaggtagaatttcacttggtttactgacttttattccaccacttgtttttgcattattttacccagaaggttttattttagcactaggctacgcaggtcaaatgtttgcattctacgccgtagtattgccagttagccttgtttggaaagctcgtcgtgcccacgctaatttgccatacaaagtgtggggaggaaatctgactttaattatcgtattggtattaggcgtgctcattacatccattccatttgcgattcgtgcgggttatttaccctttgttgtaggttaaaaacaaactaaaaatttaccgcactttttatctaaaaaagagtaaatattgtcctaattaatttagataaaaatttcagacaaaacttatcattaatcttatacaacaaaaaggctaagttctaaaattatagaacttagcccttaaactaaatgaagttcacttcatctatattatactttcaattatcgtcttgttttcaatagtttttcagtgagttcataagctcgaagttttgctaactctttagaaagttttgcaacaagtaagtcgtgatctgcatcagatccgcgagatactatattttcttctgctttacgttttgcttcgtgaatacgatctgcatctaattcactacctcgaatagcaatatctgctaatactgtcacaatatttggttgaacttctaaaaaaccaccagaaacatagataacttcttcattcccatctttaagagtaaatttaacaatcccaggcttaattgctgttagcaatggcgtatgtccgggcaaaataccaagctccccttccacaccagttacctgaatttgttttacttcaccttcaaagattttctgctctgcgcttactattgttaaattaaatgtcgccattttgttctccttcaaatgacttgaagtgattacatatttttggctttttctaacacttcatcgattgaaccaaccatatagaacgcttgttcaggaatatggtcatattcgccatctaagatacctttgaagccacggatggtgtcttttaatgtcacgtatttacctggtgaacctgtgaagacttctgcaacaaagaatggttgtgataagaaacgttcaattttacgtgcacgtgctaccactagtttatcttcttcagataattcatccataccaagaattgcgataatatctttcaattctttataacgttgtaaaataccttgtacaccacgagcaacatcataatgttcttgaccaacaacaagcgggtctagctgacgtgaagttgaatctaatggatcaactgcagggtaaatacctaaagatgcgatttgacgacttaatacaacagttgagtctaaatgtgcgaaagttgttgctggagatgggtcagttaagtcatccgctggtacgtacaccgcttgcacagaagtgatagaacctgttttggttgaagtgatacgttcttgtaacacacccatttcttctgccaatgtcggttggtaacctaccgcggatggcatacgacctaataacgcagatacttccgtaccagcaagggtataacgatagatattatccacaaagaataatacatctcgaccttcatcacggaatttttcagccatagttaaaccagtcaatgcaacacgtaaacggttacctggtggctcgttcatttgaccataaaccaaagatactttatctaatacgttagaatctttcatttcatgatagaagtcattaccttcacgagtacgttcgcctacacccgcaaatacagagtaacctgaatgctcaatcgcaatattacgaatcaactccatcatatttacggttttacctacacctgcaccgccgaataaaccaactttaccaccttttgcgaatggacaaattaagtcgatcactttgataccagtttctaataattccgtactgtttgattgttcttcatagctcggtgccgaacggtggatagcccaacgctcttcttcaccaattgctccttgttcgtcaattggttcgcccaacacattcataatacgaccaagtgtttttgtgcctactggtacttgaattgggttatttgtgttttctacttttaagccacgttttaaaccatcagatgtacccaatgcaatacaacgaactactccgccacctaattgttgttgcacctcaagtgttaaacctgattcaacttttaatgcatcgtaaacttttggcactgcatcttgtggaaattcaacgtcaatcaccgcaccgatgatttgtacaatttttcctgctgacattaccgttcctcttttcttaaatcgccgccgcaccggctacgatttcattcaattcatttgtgatacttgcttgacgagctttgttgtacaccaaccgcagatcattaattaaattacctgcattatccgttgctgctttcattgctaccattcgagccgcttgttctgaagctacattatctacaaccgcttgataaatttgggactctaaataacgaactaaaaggctatctaatagtacttttggttctggctcataaagataatcccaagtctgttgtctttcatttaaatgatcgtctttagattctggtaaaggaactaattgttgtacaacaggcttttgcgacatcgtattaacaaatttattgtatgcaatataaactgcatcaatttcaccattacgataagcatcaaacattgtatttgccacaccaattaattcttctagagcgggcgtatcgcctaaaccagaaagctgacctttgatattaaatccaaaggaacggaaaaaactaatcccttttgaacctattaagcccaaatctgtagaaatattttgttctttccaattttttatttggttaagtgtggttttgaataaattaacatttaacccaccacacatcccacgatctgttgaaataaccaagataccgattttcttcacttcgcgctcaactaagaacggatgtttataaccgatacttgccttagacacatgactaataacgttacggatagtttcagaatacggacgagatgcagccatacgatcctgcgttttacgcattttcgaggttgccaccatttccattgccttagtgattttttgtgtactttgtacactggcaattttggtttttatctcttttgcacctgccatcttatctctccgttactaccaagcactattcgctttaaaaccatctaaaatactttttaaagtatctttgatttcatcattatagttaccggttttattaagctcttgcataaattcagcgtgattacggttagaataatctaaaagtgcggtctcaaaacttgcaatttttgataattccacgtcatccaaataaccaaattcaacagcaaacaatataaccgcttgttctgcaacagataatggcgtgaattgtttttgttttaataattcagttactttttcaccgtgagaaagttgcttacgagtcgcatcatctagatctgatgcaaactgtgcaaacgctgctaattcacgatattgagctagcgcggtacgaataccacccgctaatttcttaataactttagtttgcgctgaaccaccaacacgagataccgaaatacctgggtttaccgcaggacgaatacctgagttaaacaagttagattctaagaagatctgaccatcggtaatagaaattacgttggttggaacaaacgcagatacgtcaccagcttgggtttcaataatcggaagtgcggttaaagaacctgtttttccttttacttcgcctttagtgaatttttctacataatcttcatttacacgagaagcacgttctagtaaacgagaatgtaaatagaacacatcacctggataggcttcacgacctggtggacgacgtaataataatgaaatttgacgataagctacggcttgttttgataaatcatcataaacaattaacgcatcttcgccgcgatcacggaaatattcccccatcgcacaaccagcataaggggctaaatattgtaacgctgctgattcagatgcagatgcagctaccacgatagtatttgcaagcgcaccatgttcttctaatttacgcacgacatttgcaatagtagaggctttttgaccaatcgcaacatagatacatttaatacctgaattacgttgattaataatagcgtcaattgctaacgcagttttacccgtttgacggtcaccgatgattaactcacgctgaccacgaccaatcggtaccatagaatcgacagctttataaccagtttgaacaggttgatcaacagaacgacgatcgataacacctggcgcaatcacttctactggtgagaaaccatcattttcaatttcgcctttaccatcgattggctgaccaagcgtattaactacacgacctaataaaccacgaccaactggtacttcaagaatacgacctgtacattgaacttccataccttccgctaaatctgcgtaaggtcccataactacagcaccaacagaatcgcgttcaaggttaagtgccatcgcataacgattacctggtaaggcgatcatttcaccttgcatcacatcgcttaaaccgtggatgcgaataataccatcgcttacagaaacaattgtccctgtattacgcgcttcactgaccacgtcgaattgagcgatgcgttttttaatcaattcactaatttcagttgaatttagttgcatcttgtattcctcttataattgcaactcgtttgcaagacgagtaagttgcccacggctacttccgtcaatcacaaagtcttcagtacgaacaatcacaccagcaataagtgcgttatccacgttgcaatttaatttcactttgcgagctaatcttttttccattgcagctgcaattttttcgatttgtgttgcattcaatggttgcgcagatgttacttcaacttctgcaatagcttggtgttcctctacgtgatgtttaaattcttcaaacaccgcaggaatagcactcaaacgcttattttcagccattaaccgaataagattttgcccatattgatccaattgttcgccacaaatagaaattactgtatcagctaatttctgtgcagaaagagaactacttaagtaagcttttaccgtttcatcttcagctacggcagcagcaaaacctaacatttcagtccatttttcgaccgcactttgttcaatggcaaagtcgaatgcagcttttgcataagggcgagctattgtagttaattctgacataagctaagcctcttataactctgcaactaatttatcaataatgtcattgtttgccgcttcatcaatagaacgacccacaattttctcagcaccagccactgccaatgaagctactttaagacgtaattcttcttgaacacgtttacgttctgcttctacttcagcataaccttgtgcaataatttttgcttttagttcttcggcttctgccttcacttcgtctaatacttcattgcgacgtttattcgcagcatctaaaatgtcttgagcttgtaattttgcagctgaaagttcttgttcaacaagatttttcgtatctgcttgctcttttttagctgcttcagctgacgctaaagcgttcgcaatttggctttgacgtgtttcaatcgcattaataattggtggccaaacaaacttcatgcaaaaccacacgaaaagtgcgaatgcgataagttgaccaatcaatgttgcatttaaattcacaacgtcctccttactatgcttgttttacgttgataagcaaataaggtgattagtttaataaaccgatgaatgggtttgcgaaaatgaaaagtaatgaaataccaacagcaatcattgcaatcgcatctaaaagaccagctacgataaacattttagtttgtaagctagatgctaattctggttggcgagctgatgattctaagaatttaccacctagaatagcaaagccaattgcagtacctaatgcagcaaatgcaagaagaattgatgcaccgatgattgttgctgtaattacagtttccataattttctccaatagaagttaagttttagccctagagccggttaataaaaaacgattaatgatctgctttgttataagcaatacttaaataaacaaccgtcaacatcataaagatgaaagcctgcaaggtaataaccaaaatatggaaaatagcccaagcaagatgtaacggaatccctaatgctgcaatggccatattagcggaatacattacagcgataagaataaagatcaactcccctgcatacatgttaccgaataaacggaaggcaagtgaaattggtttagccaataaagtcaccgtttcaagaataaaattaacaggaataaacgcccaatgattgaatggatgaagcgtatattctttaactaaacctttgaatcctttagattttattgtataaaaaagaattaaaaagaaaacacaaatggacatacccaaagttgcgctaatatctgctgtcggcactgcacgaagataatgaataccgaacaaacctgcaaattgaggtaagaaatcaacaggaattaagtcgatagcattcatgatgaatacccaacagaaaattgttaatgcaagtggcgcaactacgttacgtggaccatgaaaattttctttcacgattccattaacccattccacaacaatttcaactaagcattgcatttttcctggaacgccagttgttgcttttttccctactcgagaaaaaacaaataggaaaataaccgcagcaagaatagaaaagaacaacgtatctatatgaacattccaaaatccatcccctgttttgagaaaggataaatggtggctaatgtattccgatgttgtttgtccagacataatcgatcctttgttctgaagaagaataacccaaagttaaattttattgagaataagtggaataatattattcagcactaatgccaataaaaaaccaacaaaaaacgcaataaaattgataacgaataaccatttgatggcaataatgataaaaaccatcgttaaaataaactttattgcttcagcacgataaagtgcggtcagttttgttgaaaaattttgttttctgtaaaaaatgataaatataaatgtacaaaaaggcaaaaaggcacttaaaaaaccgtagctaaaatctaccgcactttggcgttgccatccataaataagcaaataaaaaactacaagcaaaagactctcaataacaatagcttttctgtagttttttttagcgtgagataaaatgcgcgacatcacttttacaaaataattttagcccgccgattatacctttgctggctttagattcaacttaaaaacacataaaaagtgttatataaatcacacttttagaaaataatttatctatttgttactttttaacgtaaaacgattaaatgtcgttcgcctataagttcaggtacagataattcaatcactttttgaatagtatattttttattcaattcattaatttcatcttcctgataaatcccttttaatgcataaaaatatccattttcttttggtaaatgatggcaccaatctgtcatatcttttagtgaagcaaaagcacggcttaatacaccatcaaatttatcttcaggttgatattcttctactcgacttaaaacgggggttacattagttagtctaagctcacgtatagcatttcgaataaaactaatacgcttacctaagctatcaaggaggacgaattgtttggaaggattaataattgccaaaggtaaaccaggcaaaccaggccctgtaccgacatcaataaaacgatcaccttgtaaataaggacttacaacaagactatctaaaatatgtttaactaacatttcttgcggatcacgaactgacgtcaaattataagctttattccatttattgagtaaattgaccagattaatcaactgctgaatttgttgatcacttatttttatatttgcttgcgcaagtaaactgactaatttggctttcatatttattatctctttgaaaaattacgctattttacttaaaagtgcggtaaatttccttaatgtttttagtaatttgatgaattatttaccgaatcaatgtccagttttacaccataaattgaatgcacctccgcataattcatttcaaaggctttaattgcttctgttcaagaaccaaagaatgaatgttcgctaaaaaataagtttgttctgcttcaggaatggaaaatggcattaacttgagtaaatcttgatgaatagctaaaacttgtggaaaaatgaccgcactttgcatttcttcgagcatttctgaataaagcgaagaaacacaacctcctcgttctattcgacctaagctgcaagcaatgtgtagcagcataaaatccacttgaggcgtattcacatcagcttgccagtaatgagctaatcgatctcgtaaacgaaatatcacatcaataatagattgatttatttgcctgcgaattttccaacgttctagttgcttaaataaccgcatttgtttttgttagttcaaaatttgttcgctaatttaccgcactttactgaaataaaacagtgcatagatcacagttttgtagcaaaatggtaaaaaaatttgtaaggatgtaaaaatgttagattacgagatcttcaatccatatgaaggattgatttttgatatggatggaactttaattgatacaatgcccgtgcatgcacaagcttggacaatggtgggaaagaaatttggctatgaatttgattttcaaattatgtataacttcggcggggcgacggttcgaactatcgcgggggaaatgatgaaagcggcgaatatgccactagatcgaattgaggatgtgctggctgcaaaacgtgagttgtcttatcaacttattccgactcaatcaaagttattgccaacctttgaaattgttaaatccttccatcagaaaaagccgatcgctttaggttctggctcacaccgtaaaattattgatatgttgatggataaactggctatcgcaccttactttaatgcaattgtcagtgcagatgatgtaaaagaacataaaccacacccagaaacttttttacgttgtgcggagttaattcaagcaaatccaagtcgttgtatcgtatttgaagatgcggatttaggcgtgcaagcaggattaagtgcgggaatggatgtgtttgatgttcgcacacgagaaattatttcgccaagataatggatattttttcattttttagtgctgatttttggcaggctaatagcttatgctttatgtttatcagcgcgtttttgagtgcaacagtattaccaggtaattcagaagttatatttgttgcgcttgctgtacctaaattaatgttaggttctttatttaacgtagatatattagctctaatattgattgcaaccgctggaaatagcttaggaagtttaaccacttacggaattggacgatggatgccaaaattcgatcccaaaaattaccgcactttatgggcaataaatcagctacggcgttatggggcgattgctttacttttgagctggctgcctgtagttggcgatttattttgtgccatagctggttggttaagattaaattttgtaacgagcagtctctttatctttctgggaaaaatggttcgttatgttgcgttattgtttttgagtacaccattcttattataaaatgcgcaagaaaaagccccacaataaacgtggggcaaataacctaaggaaccaattttattaaaacaactgcaagttgcttacactataagactaatgctttataagaaagttcaaaattttttaaaaattttcaaaataaaaatttttgcataaaagaaaccccacaataaatgtggggcaataacctaaggaaccaattttattaaaacaactgcaagttgcttgttctataagacaatgaaccttactataaagttcattaaaatttgtaaaaaataaatatttattcaattatttcttaaccaactgatttataagggaaatttatgccattacttgatagttttaaagtggatcacacaaaaatgaacgcacctgcagtacgcattgcaaaaacgatgctcacgccaaaaggcgataatattactgtttttgatttacgtttttgtattccaaacaaagaaattctttccccaaaaggcattcatacacttgaacatttatttgctggatttatgcgcgatcatttaaatggcgatagcatagaaattattgatatttctccgatgggatgtcgcacgggattttatatgtctttgattggcacaccaaatgaacagaaagtgtctgaggcttggttagcttcaatgcaagatgttttaggtgtacaagatcaagcttctattcctgaattaaatatctatcaatgcggaagctatacggaacattccttagaagatgcacacgaaattgccaaaaatgttatcgcacgcggtataggtgtaaataaaaatgaagatttgtcactcgataattccttattaaaataggaagacgcttgattaacctaaaaaagttagtagtaaaaaacgcactttatgatctaccccaaaagttgactaaataaccaactaaggtgtagatttttttatgaccaaatacaacactcttttcaaacaacaagtcattgaattttatcttcaaaatggtaaaaatcgttcacttacccgcaggtattttcaacttgcctaaataacactaaaacgttggattaaccaattaatcatagttaaatcaatagattatccgtacttagtaagaaggcaaaattacttacctgaatttaaacttaacataatacaagcggttaaaaatgggcaattttctgcagaagccgcatatttacattttggcattaccaattcagacgttgttagtcaatggctgcaagcctttgaaaaacaaggtataaacggcttaatcctcaaatctaaaagtcgtccaatcatgaaaccgaaataccctaagatgccacctaaaccgaaaacatgaggggaagaactagaattggaaaatttactacgtgcggagaacgcaatcctaaaaaagttgcaagaactcaaccaacaaaaaaagacttgaagacgcaaaacccaattttacattccgaccaaggttggctgtatcaaatggtcggttatcaggcgattttacgagagaatagcattcaacagaatatgtcaaggaaaggaaattatttagataacaatgcgatggaaaacttctttggacgattaaaaactgaatgttattacgacaaacgatttgagacgttcaaacaactgaaaaaacaactcatgagtatattcattattacaaccatgatcacattcaggggaaactaaaagggctgaaccctgtgaatgacagaactcagtccttgaactaaatcaatctaactttttgggggaagataaatcccaacttgcggtcaattaatagcttgaattgattaacacttcttcgccatagccgcctaaagttggcattggttgataagtagagtttgcggcacgcattaaacgaataccacgaacacctgcttctttagctgctagtacatcatcatcgctgtcgccatagtgaatactcactttatgtgaaatgattgcaggcgttttgttatattttgttgtacgttcacggctgcccataaattcaactgggtgcatattcttaatattgaacgttttttctaaaattggtgttacaccatccactttgccagcagtacggccagtgaaaaagtaaacttggtcgccacgtgcttggtgcatattaattaaatctatggcaatttgtttaggaatagaatatttatcgcaacctgcatttacttcattccagaaatcttggtttttcaaataatcgtgtttacctggtgagaatttttgttgtccgtggtaaaagcaagggctactgaaaagcacggtatcatcaatatcaaaagcttacattaattggtgctttaccttctaaactttgtttgatttgatcaacactaatccaatgaattgcttgctcttgtaacatttcacgagcattagtgccagattgagtataaggttctgttttgcctgccatcgctggaactgcagctgcagttaaaagtgcgattacagataatttcatgacgtttttcattgcctttcctcacaaacgctgatttaaaaaccgctcagatcatacattttttagcttatattcaataattagcaatcgtttgccatctcaaaatatgatcaacttcacattttttatttatgagtgaagaataaatctacaatataaatttccctcttgaatttaatcaatttgtcgccatataacgaacaacttttcactttataaaggacagaacaatgacaacgattgtaagcgtacgtcgcaatgggcaagtcgtcgtaggcggtgatggacaagtttctttaggcaataccgtaatgaaaggtaatgctcgtaaagtacgccgtttatataatggcaaagtgcttgctggttttgcgggtggaacggcagatgcatttacactttttgaattatttgaacgtaaacttgaaatgcatcaagggcatttgctaaaaagtgcggtggaattagcgaaagattggcgtacagatcgcgcacttcgtaaattagaagcgatgctaattgttgcggatgaaaaagaaagtttaatcatcacgggtattggcgatgtggttcagcccgaagaagatcaaattttagcaatcggatcgggtggtaactatgcgttatctgcggcacgtgcgttagtggaaaatactgaactttctgcacatgaaattgttgaaaaatctttaagaattgctggtgatatttgcgtgttcacaaataccaatttcactattgaagaattaccgaattaaggaaaaagctatgtctgaaatgactcctcgcgaaatagtttctgaattagatcaacatattattggtcaagccgatgcaaaacgtgctgtggcgattgcgttgcgtaaccgttggcgtcgtatgcagcttcaagaacctttgcgtcatgaagtaactccaaaaaatattttaatgattggcccaactggtgtgggtaaaactgaaattgcgcgccgtttagcaaaattagctaacgcaccatttatcaaagtggaagcaacgaaatttactgaagtaggttacgtggggaaagaggtggattccattattcgtgatttaacggatagtgcgatgaaacttgttcgccaacaagaaattgcgaagaacagagcaagagctgaagacgtggctgaagagcgtattttggatgctttacttcctccagcaaaaaatcagtggggcgaagttgaaaaccatgatagtcacagcagtactcgccaagcgttccgtaaaaaattacgtgaaggtcaattagatgataaagaaatcgaaattgatgtgtctgctggcgtatctatgggggttgaaattatggctcctccaggcatggaagaaatgacaaatcaactgcaatcattgttccaaaatttgggttcagacaaaacgaaaaaacgcaaaatgaaaattaaagatgcgttgaaagcgttgattgatgatgaagcagcgaaattaattaaccctgaagaacttaaacaaaaagccattgatgctgtggaacaaaatggtatcgtctttatcgatgaaatcgacaaaatttgtaagaaaggtgaatacagtggtgctgatgtatcgcgtgaaggtgtgcaacgtgatttacttccgttagtagaaggctcgacagttagcaccaagcacggaatggttaaaactgatcatatcttatttattgcatctggtgcattccaagttgctcgcccttcagatttaattcctgaactacaagggcgtttgccgattcgtgttgaacttaccgcattaagtgcggcggattttgagcgtattttaacagagccacatgcttctttaaccgaacaatataaagcgttgatggcaacagaaggggtgaatattgcattcacaacagatgcagtgaagaaaattgctgaggcggcattccgagtgaatgaaaaaacggaaaatatcggtgcacgccgtttgcatacggtaatggagcgtttgatggataaaatttctttcagcgcaagcgacatgaatggtcaaacggtcaatattgatgcagcttatgttgcggatgcacttggcgaagtggttgaaaatgaagatttgagccgttttattctttaaagataaaaattttacatataaaagtgcggtaaatttttaccgcacttttttgttttcaggatagagaaactaattagtttttaatttgccccaatatttttcataaatatcaacagcttctcctacatcgccttgcataattcctttttctacttcttccgctggtgggaataattttggatcattagcaacttccgcgcttagcaatgttttcgccccattatttggcatagaaaagcccatgcgttcgataacaatttttgcattttcagggcgaagtaaaaagtcaatgaacttatgtgcaccttcaacattttttgctgtagtcggaatcgcatagttatccatccagaaaattgcaccttcttttggatacacaaattgaagagattgattttctttctgcgctaaataagctgaaccattccaaatcataccaattgcaacttcgccttgtacgtaagggacttcaggagaatcagagttaaaagtcgctacatttggtaacagtttttctaaacgctcataagctgttttgatgtcttcttcattggtggtatttggcgatttaccatccagtaataatgctacgtggaacacttcacgtgcatcactggtcatgagaactttgcctttaaattcaggtttccataaatccgcccagctagtgatggttttaggatcaatctcatccgcattaacttcaataccagttaagccgtaaacgtaaggtaatgaatatttattttctgggtcgaattctttatttaataaatgtttagggatttgatgaatattggtcaatttactttgatcaatcggttgaagcatcttttccttaatcattttatttacgtagtaacttgatggaaacaccaaatcatagccagaaccagtattctgagtaagtttaagtttcgcatacatttcttcgttgctttcaaaggtagaataaattacctcgatgccagtttctttagagaactgtgcgactaaatcagaaggcacatagtctgtccagttatagacgtaaagtttgttattggcaaaagcggaagccgcaaaaagtgcggtggtggaaaggaaaagatttttgagtgagtgagcaaagaattttttcaatttattgacctccgagggttatcgttcatcataaaacacgcaaattttgcgcgcgcgcagtatagcatttttttctaaaaggtttgacatatttccctttcggggtaagattttgccagttttttcctaagggattttttatgcttaattttgcctatcaagaacacgttcgctcttattatttcgactctcgtaaccaagattttcaattcccgccgctcactcaaattgaacatgctgatgtatgtgtgatcggggctggattttttggtttatctgcggcattagaactggcggagaaaggaaaaaaagtcattgtcttagagggtgcaagagtaggctttggtgcttctggtcgcagtggtgggcaggcaattaatggctttgaagaaggcattgatgaatacattaaacaagttggcgaagataaagcacataaactttggaatatgtcattagagaccattgatattattgatgaacgtattgaaaaatatagcattcaatgcgactggaaaaaaggctatgccacattagcattaaatgaacgccgaatggatgacttaattgaaatggaaaaagaaagtcataaaaattttggctatcagaatatgcaactttgggataaaactaaattaaaacagcacttaggcagtgatatttatgtgggggggctatttgatagtaattcagggcatttgcatccacttaattattgcttaggtttagcgaaagcttgtgtcgatctgggtgttcagatttttgaacaatctcctgtcgtggatatggttgagaaaaatggttgcgttgaggttaaaacagctaaaagtgcggttatttctcaagacgttattttagccaccaatgcttatattgatgtgctcccgaaatctattcatcacggcattaatcgtaaaatattacctgtggaaagttttattatcgccacagagccgttaagccaagcggttgctgattctgtcattaataatggcatgtcggtgtgtgataacaatttattattagactattatcgtttaagtgctgacaatcgcttgctttttggtagtgattcgagctcagaaaaagatatggtcgcgattatgcggaaaaatatgttgtgtgtattcccgcaacttgaaaatgtaaaaatcgattatggctgggctggcccgattgatatgaccttaaattcaacgccacattttggtcgtatttctccgcatatttattttgctcatggttattctggtcacggtgttgctttgactggtcttgcggggcgaattgtagcggaggcgattttgggtgacgatgaacgtttatctatttttgaaggactgaaagtcccttctgtttatggtggtcgaattatcaaagatcttgcgacaaagattggtgtgcagtattacaagtttttagataaataccgttaaaatacaacaatgtttttctaaagcattgccatcaaaattgactaaaataattaaattttgtatggatataaattctaaatcagttaaaaaatttaccgcactttaaagcaagaattaaaataatatttttcgctacaatttgtgttttccattaagagagaaatatgtcagaaaatttgttacttttcagcttgttagctgttgttattatattgattttattacttattctacgccaggcaaaaatatacacatcttcatcaagaattatcgaaaacgactcaagattataatcagcttgccagtaaatttgatgaacttagtagcattaaaaaccagtttgaacaacaaacaattaaagtacagactgaaaatcaaggactgcaatatcgtttaactgaacgtgatgaacaaatacatcatctcacgcaagaacgacaaaatttgactgaaaaattgaccgcactttctcaagaattaacggggttacaaacaaccttaacagagaaagaaaaatatttttctgcacaacaacagaactttgaacaatccaaacaacaattgggcgtggaatttcaaaacctagcaaatcgtattttggatgaaaaaagtcgatcatttagtcaatcaaatcaaacggcattggaaaccttgctcaagcctttccgtgagcaaattgaaggtttccaaaaacgcgtcaatgaaattcactccgaatccgtgaaaggcaatgcaggcttggaagcggaaattaaaaaagtgctggaaattggtctgaatatgtcgcaagaggcgagtaatttaacttctgcactgaaaggcgaaaagaaaacgttaggcaactggggcgaagtgcaattagaacgagcgttgcaactggcaggacttgaagaaaatgtacattaccgcgctcaagcgcattttaaagatgaacaaggtggacgaaattatcctgattttgtgttgaatttacctgatgaaaaacacttaattatcgacagcaaaatgtcgctcgtggcttacgaaagtgcggtgaattctgaggatgattttgaacgagagcgtttactaaaagaacatatttccgcattaaaaacccatattaacgatctgcataaaaaagattacagcaatctgattggcatgtgcagcccgaattttgttcttatgtttattgcggtggaacctgcgtatattgaggctttaaaagctgatcctgccttatttaattacggttatgaacgcaatgtaattatggtctctcacactacgctaatgccgattttacgcaccgtggcaaacctctggcgtatcgaacgtggtaatgctgaagccaaagaaattgctgaaaaagcgggcgaaatctataaccaaatttgcttggtggcagagcgtttaaacaaactcggcaatacgctttccactgtcagcaaccaatacaatagcaccgtcaccgcacttgttggccaacaagggttagttggcaaagtagaacgatttaaaaccctttccgcaaaagccaataaaacaatgcccgatgtggacttattgaataatcagctggatttggctagattgaatgtcttaaatcaagaaaatcttcaataatttattctccgattccgattgaatgtaaatttggtcggagaattttttatcctatctagaaattttgtgatcaatatcccaaatttgaaatttcttagttgtttttctatttttgttatctatatttgtcttatcgaaacgtttcgataacaaaaaggagcttttagatgaaaaaaacagctttattgaatgcgcaactttcgcattgcattgctacacttggtcatacggaaagtttgacgatttgcgatgcgggacttccaattccattaagtgtggaacgtatcgatctcgcattaactgcgggtgtaccaagttttctacaaacgttgaatgtagtaacgaatgaaatgtatgtngaacgcgttgttattgcagaagaaattaaagaaaaaaatccagaaatattgaccgcacttttaacacaacttcaaaaacttgaaagccatcagggtaatcaaatacaagtggaatttgtatcgcacgaaacttttaaaaaattcaccctcgaaagtaaagctattgttcgtactggcgaatgttcaccttatgccaatgtgattttatattctggcgtgccattttaatcagggtgaaattatggaaactttactcaaaattagtggtgttgataaatcatttccaggtgtgaaagccttgaataatgcctgtttatctgtttacgctggacgcgtaatggcattgatgggggaaaatggggcgggtaaatcgactttgatgaaggtgcttactggtatttattctaaagatgcaggcacaattgagtatcttaatcgatcagttaatttcaatggacctaaagcctcacaggaagctggcattagtattattcaccaagaactgaatttggtcggtaatctcacgattgcagaaaacatttttcttggtcgtgaatttaaaacctcgtggggagcgattaactggcagaaaatgcaccaagaagcagacaagttacttgcgcgtttgggggtaactcacagcagtaaacagctttgcgctgaactttctattggtgagcaacaaatggtggagatagccaaagccttaagttttgaatccaaagttatcattatggatgaaccaaccgatgcgctcacagatacggagaccgaagccctattcaatgtgattcgtgaactcaaagcagaaaatcgtggcattgtttatatctctcatcgtttaaaagaaattttccaaatttgtgatgatgtgacggttttacgcgatggtcaatttatcggtgaacgcgttatggcagagattacagaagatgatttaattgaaatgatggttggtcgtcgtcttgatgaacaatatccgcatttatcacaagaaaaaggcgaatgtgtattggatgtgaaacatgtgagcggaagcggcattgatgatgtttccttcaaattgcatgccggtgaaattgttggtgtctcgggcttaatgggcgcgggtagaacggaactcggcaagctactttacggtgctttgccaaaaacggcgggaaaagtgcggttaaaaaatcaagagattgagaatcgcagtccgcaagatggtttggataatggtattgtatatatttctgaagatcgtaaaggtgatggcttggttttaggaatgtcagtaaaagaaaatatgtcgctcacatcgctcgatcatttttcacaaaaaggcggtattcgtcatcaagcggaaaaaatggcagtagatgactttattctgatgtttaacattaaaacacctaatcgtgatcaacaagtaggtttgctatctggtggaaatcaacaaaaagtggcaattgctcgtggattaatgactcgcccaaatgtgttaattttagatgaaccaactcgtggcgtagatgttggcgcgaagaaagaaatttatcagttgattaacgaatttaagaaagagggcttgagtattttaatgatctcatctgatatgccagaagtgcttggtatgagcgatcgagtgttggtaatgcgtgaaggtaaaattagtgcagaattttctcgtgaagaggcaacacaagaaaagttattagcagcagctattggtaaataagagtaggtaagtatgatgaaaaatgaaacatctaattttcaaataggaagatttttgattgaacagcgttcttttattgcattgattattcttatcgcgattgtatcaatgattaatcctgatttttttagcgtagataatattttgaatattttacgccaaacttcggttaatgcgattattgcagtgggtatgactttcgttattttaattgcaggtatagatctttctgttggatctgtattggcattgacaggtgcaatcgccgcttcaatggtgagtattgaattgcctatttttttagtcattcctgtggttttattgattggaacacttcttggtggcataagtggtgtaattgtggcaaagggaaaagttcaggcttttattgctaccttggttaccatgaccttactgcgtggtataacaatggtttatacagatggtcgtcctattacgacaggtttttcggataatgctgatctatttgctagcattggtacaggctatgttttaggtatcccagtaccaatttggattatgagtatcgtgtttgcggttgcttggtatattttaaaagacacaccaatcggtcgctatatttatgctttaggtggaaatgaggcagcgacccaactttctggtattaacgtcaataaaatcaaagtatttgtttttgcggtgagtggatttctttctgcgctggcgggtttaattgtaacttcacgtttatcttccgctcaacccactgctggcgtatcttatgaattagatgcaattgccgccgtggtagtcggtggaaccagtttgatgggggggaaaggtcgtgtaatgggaactctcatcggtgcattaatcatcggatttttaaacaatgcattaaatttattagatatttcatcttactatcaaatgatagcaaaagcgttggttattttggttgctgttttagccgataactatcttggtacaaaaaaactgtaactcactttaaggagaaactatgaaaaaactaaccgcacttacttctgctgtattattaggtttggctgtttctagctctgcttctgcgcaagacacaatcgctttggcagtatctacattagataacccattttttgtaacgttaaaagatggcgcacagaaaaaagcggatgaattaggttataagttagtagtgcttgattcacaaaatgaccctgctaaagaattagctaatatcgaagatttaactgtgcgtggtgcaaaaatattattgatcaatccaactgcttctgaagctgttggcaacgcagtggcgattgcaaaccgtaagcatattccagtaattacattagatcgtggtgcagctaaaggaaacgtagtgagccatattgcatctgacaatatcgcaggtggtaaaatggcaggtgattttatcgcacagaaattaggcgataatgccaaggtgattcaacttgaaggtattgcaggaacatctgcggcacgcgaacgaggtgagggtttcaaacaagctattgatgctcataaattcaatgtgcttgccagtcagccagcagattttgatcgaacaaaaggtttgaatgtaacggaaaatttgttggcatctaaaggtgatgttcaagcaatttttgcgcaaaatgatgaaatggcattaggtgcattacgtgcggtgaaagccgcaaataaaaaagtccttatcgtaggttttgatggtaccgatgatggtgttaaagcggtaaaaagtggcaaaatggcggcaactatcgcacaacaacccgagcttattggttcattaggtgttgttaccgctgataaaatcttaaagggcgaaaaagttgaagcgaaaattccagtagatttgaaagtaataagtgaataatctatctactaaataagctcgttatatcacattatggggcaaattatatttgtcccattgtgtagaaagaaaaaatataacaatacaggataaaataatgagaaaaaccctcacggttctcggtagtatcaatgctgatcacgttatttctgtgccttactttactaaacccggtgaaacgctaacaggtcaaaattatcaaattgcctatggtggcaaaggtgccaatcaagcagtggcagccgctcgtttaggggcaaaggtagcgttcattagttgcattggatcagatagcataggcaaaacaatgaaaaatgcgtttgcacaagaaggaattgatacaacccatattaataccgtttcacaggaaatgacaggaatggcatttattcaagtcgccaagtctagtgagaacagtattgtgttggctagcggtgcaaattcacatttgagtgagatggttgttcgtcaaagtgaggcgcaaattgcacaatcagattgcttgttaatgcaattagaaaccccactttctggtgtggagctggctgctcaaatcgctaagaaaaatggtgtcaaggttgtgctaaatcctgctccagcgcagattttatcggacgaattattgagtttgattgatattattacaccaaatgaaactgaagctgaaatcctgactggggtagaggtagccgacgagcaaagtgcggtgaaagctgcgagtgtttttcacgataaaggcattgaaaccgtaatgattacccttggcgcgaaaggtgtgtttgtcagtcgaaaaggtaaaagccgtatcattaagggcttttgtgtgcaagcaatagatactaccgcagctggtgatacatttaatggcggttttgttacggctttattggaagaaaaatcctttgatgaagccattcgttttggtcaagctgccgctgcgattagtgtgacgaaaaaaggggctcaatcctctattccaacgcggcaagaaactttggaatttcttgaacacgcttaaagtgcggtgaatttttagggtgtttttatggcgacaatgaaagatattgcacgactggcgcaagtttcgacttccacagtttcacatgtcattaatggatcgcgttttgttagcgatgaaattcgtgagaaagtgatgcgtattgtcgctgaactgaattacaccccctcagctgttgcacgaagccttaaggtgcgcgaaaccaaaactatcggactacttgtcaccgcaacaaataatcccttctttgcggaagtgatggctggcgtggagcaatattgtcagaaaaatcaatataatcttattattgctacaacgggtggagatgccaaacgcctacaacaaaatctgcaaactctaatgcacaaacaagtggatggtttgcttttgatgtgtggtgatagccgttttcaggctgatatagagttagccatttcgctgccactggttgtgatggactggtggtttactgagttaaatgcagataaaatactcgaaaattcagcacttggtggctatttggcgacaaaagcattaattgatgcaggacatcgtaaaattggcattattacgggaaatctcaaaaaatctgtcgcacaaaatcgtttgcaaggttataaaaatgcgctctcggaagcaaaaattgcgttaaatcctcattggattgtcgaaagtcattttgactttgaaggcggtgtacttggcatacaatctttacttactcaatcttcacgtccaacagcagttttttgttgtagtgacaccattgctgtcggtgcataccaagctattcagcaacaaggcttacgtattccgcaagatctttcaattatgggttatgatgacattgaattggctcgttatctctcacctcctctctccaccatttgccaaccgaaagctgaacttggcaaactcgctgttgaaacactattgcaacgaattaaaaatcctaatgaaaattaccgcactttggtgttagaaccgacttgtgtgttaagagagtctatttacagtttaaaataaaattagaataactcgatttctctattgctattttcaaaaaaactgctattttcttgcggtttttttgtttatttaacccactgtttaatttaggaataaaatcttatgaaagaaaacaaacctgttgatccttatgcgaaatataacgaacaatcgaatattatcgcgaaaataatttttgctagtcgctggttgcaagtgccgatttatttgggcttgattgtcacccttgcaatctactcttataaatttatcaaaggattatgggagttagtgattaatgtaaatgatatggattccaacacaattatgttaggcgtgttgaatttgattgatgtcgtgatgatcgcaaacttgcttgtgatggtgactatcggtggctatgaaatctttgtatctaaattgcgtacgcgtaatcatcctgatcaacctgaatggatgagccacgtaaatgccaccgtgttgaaagttaaactttctatgtctattatcggcatttcatctatccatatgttgcaaacttttgtgaatgcaagcaatatgccagaaaaaacgatgatgtggcagttattgttgcatttgggctttttagtgtcggcaattgctttagcttatacggacaaaattttgtatagcacaagccataaaacgcattaaaaatttaccgcacttttaaccccgttcaaattgaacggggttttatatatcatatagttacaatttaattttttagtatgatacgccgtttagaataggaaagcttaaataaaatactaagatgttaatcaagtagaaattaatcttctaaatctagaggctcttgcgaaagtataattcctgtcagatctgcgtaaatataatcttctgggaaaaaggttacgccaccaaaattcactggaatatcactctcgccagcactgctttcatctgcactaactggaattggcgcaagggcatgaataccaatatcgaggttttctaattgctgaatttggcgtactgcaccatatacaataatgccttcccaaccattatcaacggcaagttgagccaattctgcatcaatcaaaccacggcgtaccgcaccaccgccatcaatgacaagcactcgaccttcgccgttttcttctaatacttcagcaattaatccattactttcaaagcattttactgtagtgactttaccgtaaaawttacttacgccaccaaagcttgaaaaaattggctccacgacatccacttgttctgcataaagatcgcaaagttctgaagtatcaataaacataactttcccctatcgattgttgaaattttgtttgctttagtatatgccgatttagccgataagcaagcctaaactaaacaagatattgattaataacgaaattcatagacatttgagccaatattggacgcaattcacttggctgctgactgcaataaacaaagatcgcatgtttagctaacaacggcattgctaatacaaataaataatttgtccaagaaatagccgttgccaccgcaaatgctaaataacatagggccgccacacttaataaaatacaatgataaacacgccctttatatgcacctaaacgaacggctagggtatttttgccagctttcgcatcctgttcaatatcgcgtaaattattgatatttaataccgcacttgccaataagccagaaccaatagcaggcaaaataatgtggctatcaatactgtgagtttgcaaataataagtaccgccaacaccaagcaaaccaaaaaataccaatacagaaatatcgcccaagcccatatagccataaggttttaccccaactgtgtaagtaatggcagcaacaatagctaaaattccaagcccagcgaaagcgaataaatctgagagattttcataagcgattccaatcaagaaacttcctgaaagaaaacttgccatcaccattaggattaatccccatttcagttcttttgctgaaattgcgcctttttgaatgccacgtaatggcccaatacgttcttcagtatctgaacctttttgatgatccccataatcattggcaaaattagaaagcacctgcaataaaattgtcgtgagtaaacaaagcaccattacaagcccattaaaaccttgtggattcgcccaataacctaatgccgaacccgtgaaaatcgatgccaacgctaatggcaaagtttttggtcgagccgtttcccaccacattttcaatttttcatttatcattttttttgaccgcacttttgattacaataagccgcgtattctacactaagacacccaatttatgaatgatttaaccttatcgcctatcgccattatccacacaccttataaagaaaaattctccgtaccacgccaacctaatttagttgaagacggtgtaggcattgtagaactcttaccgccttataattcgcctgaagccgtgagaggattggaacaattcagtcatctttggttaatttttcagttcgaccaaatccaacaaggaaaatggcaacccaccgtacgcccacctcggttaggcggtaatcaacgagttggtgtatttgcttcacgcgcaacgcaccgcccaaatcctcttggtttatccaaagtcgaattacgtcaagtagaatgcatcaacggtaacatttttctccatttaggtgcggtggatttagtggatggcacgcccattttcgatatcaaaccctatattgcctatgcggatagtgagccaaatgcgcaatcgagctttgcccaagaaaaactaccagtaaaactgactgttgaatttaccgagcaagccaaaagtgcggtaaaaaaacgagaagaaaaacgaccgcacttaagtcgttttattcgccaagtgctagagcaagatcctcgcccagcctatcaacaaggtaaaccgagtgatcgtatttatggtatgagtttgtatgaatttaatgtgaaatggcgaattaaagcgggtacggtaaattgtgtagaagtgattgaaatagaaaaagacaaatagatgtaatatgtaaataaggcaggtaatccctgccttagttaatttaaatgccttattttaggaaaaactgccctttagttaatttatatattgtcattaaaaccaataagccaatcattacatttgagaaaacaaaggcaaaaatagacacgccttgtaaaacattgccatgatagaaagcggtagcactgtttgccatagacgctaatccgaatgagaatgcccataagccaatgttaagtcctttttccacaatccaagggaataatcgcaataagaaaaataattgcaaaaatccatatccccaaaggattttagctaacgtatccacctcgccgtgattgatcgataaataagcagatacacacacaaacgcaggtgctaaaacaatccccatggtggctctaaattgtggctcaagagatgaaatacgtaaatgttgtaataatacaggttcaaaaataatccaagcaatcattcctgcgccaaagaataagtagcctaaatcatgatagccaagtaatgctaatgracttgcacttgtgaaatttgcagcaaccgcaggcaaataaaacgaaggatgagtagatttttgctcaaatacaccaccttgccataattcactgacacgtaatgttgagaaaagtaattgaccaatcgttccaatccaaattaaaacttcagcaattaaaggattccaacgataaagaatatcgcctaccaacatagttgtaataggaatcaatgcaataaaggaaaaacgaactgggctatgatactctgcacgaacttcctcaaagtaataacgaagtttatacgcatacattaaaataaataaaatccagaccgcacttgctacaatgccaagracatcacttaccattcgcgcagcaggaaataagttttctaaatgaaaccaagctaaagataaggctgctaaaccaagaggaataccgaaatatcctgttggaagaggaaaaggctttgttatattcatagtatganccttattttgaaaaatatgagcaaagtgtaacataactatcaacaacagacttttctaaaagtctcaaatttttgtgaatttctatgaagaaacatacttgttgntctggcataaaacctctacccattttcataaaaataaaaaaaccgnactttcattcgggttttcttatatagggaattaattattccgcatcatctgccatgttaagcatttcagctaagcttataatatcttttgaacttgaaactaaagtatatatttcttaaatggcttaacaaacttatctatcatagatatggctctttgctctgcttgagtaacaaaatgttttagataagattttgcccattcttctctagttccattaaacccctgatctaaatctcttacatgaaactgaatttgcatagctgcagcccagttaatatatagttcactaggttcagatttaaatagttcagcaaaagaagtagatacacaaactagatcttcaccattaagttcccagtctacttctaaataattaatatcaaataaatcaaattctttattatcaatcatttttgcacacgtctgagctaatttatatgctgaaataatattgggtgcttgagctgatttactaatatttcttgttttgacatctaacaattcatagaactgatcctttactaataaaatatctgcagtatcattttgtttctcctcaaataaatttnctatgctccaattttcagttgcagctttacctctacttaacaaaaaaagcaatgttggagaattaaataatttatatctagcttcatgtccaattatcgcaggcttcttcataaataaatcattaagatattcatattgcttaaatgttaaatctgacaggttttctttcaaaaacttatatactaatttttcaaatggttcccctgcagcatgacctgacagagtacctgatttaggacgtttcactttttgcccgattaatattgaattaatatcctgataaataggttttatgaaactcatatttccacctttatacctaatttttctaaatttaagttaatctcatgtaaaattgaaaattctttgtttgataaatattttcttactaaattagttatatcatcatgaatttttttttcgctttttaattgccaatctattcttctaaaaggaatatttgctaatggtttttctgaaaattcaactacattacctttgacaacacccttatacttcatccataaaaacacagctttagagtttaaatatgctgtaatatactcaatactctcctttacattttctttcttatataatgcagtaacatcctgtgttggatatataaattcatcaactaagctaaatctaaaattacttttttttgaaattctttctttgcacggcacaaatattttcttctcattcttgctgaatagagaaaaatttctaagaaaagcccacttccaataaggcaaatatttattataactatatctttttaatagataatctttataattattaaactcataaaagaaatttggaaaataagtgattaatttatcctcattaatatcatctaatatgaacttgtatctggtgtatccagagaaacaaaatgcgtctaagtgtttagctttagctacacaaattgaattaagcaattctaattctgaataatttatatcattcatctgaaaagccttatctagaccacttaccatcccattcccaatatcacagacacttccgattctagaaaactcaagatcatcaaataatgattttggctgaacttttttgatagttttgcagtaactctcaaatttatctaatgcaactttaatatgattgggcgaagtaacccaaacatctgagctagaaaatcttggaatataatatgattcacctaaagattctatatcctcagattttattgggctttttgaatctatattaataatattnatattatcaatatttttnccttttatatatttaaaaataacaactgaagangaaactccatgaaatactttactttcattaaataatataattttttcaaaacttccattatttatcaaaaatttccttaaaccctcagcgttcttagtggaaaaaaaataatcagggcaaataaatattaattctcctccaacttttaattgaagtatagatttaataataaaaatatagaaataatcacaaagactattacaatacattttccatatagaattatctttaagctctttcttctgaagctcacttaggtttttccaacgaacataaggaggatttccaatgatcgaatcatattgaggcttatcatatgatgttataaaacttgagttaattacaaatggatgagaaataatatcaccatctatttcatacgatgttaaatttgtataacctaattgaattaaactatctagaaatacaccattcccactactaggttctaaaatactagcatttttatttttcgtcattagtccaatcatatatttaacaatatgtgtaggagtaaaaaactgacctagtgatattttctttgattcatccatatttttatcctatttttctaataaaarccctcagaactctcattctgagggtttaaacataagatacaaatattaatcttctatttcagaatttaacaatgttgcaagattttgcgttgcatcatctgccgttatgacaaactcatcagcgatagcggcttcatcttcttcagataatttcgctacgacatcatcaactaagcgatgtttatgacgattttgatgatacgcaaaacctgtacccgcaggaattaatcgacctactattacgttctctttcaagccacgtaattcatcacgtttacctgccactgctgcttcggtaagaacacgagtagtttcttggaacgatgcggcagagatgaaggattcagtcgcaagagacgctttggtgatacccaataattcacgttcaaattcaactggtggtttaccttctgcttcacgttggcgattaacaattttcacgcgagccacttcgacttgttctccctcaaggaattctgagtcgtaagctttagtaattaccgctttacgtaacatttggcgaacaattacttcgatatgtttatcgttgatttttaccccttgtaagcggtaaacatcttgcacttcgttcacgatgtattcagttactgcacgcacgccacgtaaacgtaaaatgtcgtgtggtgtttcagcaccatcagaaattacatcgccacgttgtaccatttcgccttcaaatacgttgagctgacgccattttggaatcatttcttcgtaagtttcgccttccgcaggagtaattaataaacggcgtttacctttggtttctttaccgaaagacacgataccagaaatttcagccaagatagcgggttcttttggtttacgtgcttcaaataaatccgcaacgcgtggtagaccaccagtaatatctttagtacccacggattcttgcggaatacgtgctaatggttcacccacttttactgctgtgccatcgtctaaacttacgattgctttaccaggtaagaagtattgtgcaagaacatcagtttcaggtaagaaaatatcgttgccatttgcatcaactaatttaatagttggacgtaaatctttacccgcagttgcacgttcacccacatcttgaaccacgattgatgataaacctgttaattcatctgtttgacgcgtcacagttaaaccatcaataatatctacaaatttcacaaaaccagatacttcagagacaactggcattgtatgtggatcccaatttgcgatagtttcgcctgcagtgacttcttgaccgtcacctttgcttaataccgcaccataaggcactttataatgttctttagtacgaccaaatgcatcagtaatagttaattccgtgttacgagaagttaatactagtttgctttcatcgttagtcacgaattttgcattcattaaatgcactgtaccagtgtttttaacttgcacactagattctttcgctgccgcagatgccgcaccaccaatatggaacgtacgcattgttagctgtgtacccggctcaccgatagattgagcggcaataacgcccaccgcttcgccttggttgattaaatgaccacgagcaagatcacgtccataacatttcgcacatacaccaaaatcagtatcacaagttacaacagaacgtacttttacgctatctacagagtttgcatccaacacatcacagagtttttcatctaataaggtgttacgcggaattaatacttcttctgtacctggttttaaaatatcttctgcagcaacacgacctaatactaattcacgaagtggcactttttcatctccaccttcaattaatggggtcatgactaagccttcgtgcgtaccacagtcatcttctacaatcactaagtcttgtgccacatcaactaaacgacgagttaagtaacctgagttcgctgtttttaatgcggtatccgccaaacctttacgagcaccgtgggttgaaataaagtactgtaatacgttcaaaccttcacggaagtttgctgtaattggggtttcaatgatcgagccatctggacgagccatcaaaccacgcatacctgctaactgacgaatctgagctgcagaaccacgcgcaccagaatcagccatcataaagatactgttaaaggacgcttgtttttcaggattaccttcacgattgatgacttcttcttgagataagttttccatcatcgctttcgctacgcgctcattcgcggcagcccaaatatcgattactttattatagcgttcgcctgccgtcacaagacctgattggaattgttcttggatctcagctacttcttcttccgctgcagaaataatttcgtatttcttcgctggaatttccatatcatcaataccaactgatgaaccagaacgtgccgcatacgcaaaaccggtatacataatttggtcagcaaacattaccgcttcttttaaacctaaacgacgatatgcttcgttaatcagtttagaaatagcttttttacctaatgtttggttgaacaatgaataaggcatgcctttcggcgcgatcatccataagattgcacgaccgatagttgtatcagtcagcgtggttttcgcatcaaattcgcccgcttcatttttcacatattcagtaatacgcactttcacgcgagaatgtaattccgcttcgcctgtacgatatgctttttcagcttcgcgaggatcttgcaataacataccttcgcctttaccgttcactttttcgcgggtcatatagtaaagacctaataccacgtcttgtgatggaacgataatcggatcaccgtttgctggagaaagcacgttattggtggacatcatcaacgcacgagcttctaattgcgcttcaagggttaatggaacgtgtaccgccatttggtcaccatcgaagtctgcgttgaacgccgcacaaacgagcgggtgtaattgaatagctttaccttcgattaagatcggttcaaacgcttggatacccaaacggtgaagtgttggcgcacggttcaatagaattgggtgttcacgaataacttctgcaagaatatcccaaacgatcgcatcttcacgctcaaccattttcttagccgctttgattgtcgtagcataaccacggctttctaatttcgcatagataaacggacggaataattccaatgccattttcttcggtaaaccacattggtgtaagtgcaagtatgggccaacagtgattacagaacgaccagagtaatcaacacgtttacctaataagttttgacggaaacgaccttgtttacctttgatcatatccgctaatgattttaatggacgacggttagaacccgtaattgcacgaccgcggcgaccattatctaataaggcatcaacagattcttgtaacatacgtttttcgttgcgcacaataatatctggcgcaattaaatctaataaacgttttaaacgattgttacggttgattacacgacgatataaatcgttcagatctgaagtcgcaaaacgaccgccatcaagtggtactaatgggcgtaaatctggtggaagaactggcaataccgtcatcaccatccattctggtttattaccagattgaacaaatgcttctaataattttaagcgtttagtgatttttttacgtttagtttcagagttagtttcttgtaattcttcacgtaatttttcacattcagcttcaagatccataccttttaagagatcttgaatcgcttcggcacccattttcgcttcaaattcatcttgccagcgatcttcagcgtcaaggtattgttcttctgttaataattgaccgcgctctaagtccgtcatacctggttcggtcacgatgtacatttcaaaataaagtacacgttcgatgtcgcgcaatggcatatctaaaagtaaaccgatacgagacggcaatgattttaagaaccaaatatgtgcaactggcgatgcaagttcaatatgacccatacgttcacgacgaactttagtttgagtgacttcaacaccacatttttcacaaatcacaccacggtgttttaaacgtttatatttaccacataaacattcgtaatcttttacaggcccgaagatacgcgcacagaaaagaccatcacgttcaggtttgaacgtacggtagttaatggtttcaggtttcttcacttcaccaaatgaccaagaacggatcatatctggggaagctaacccaattttaatcacatcaaaatcttcactggtttttgattgtgcttttaaaaacttaactaagtctttcacaaatgttctcctgtcggagttaaaggtttaaagtgcggttaaaaatttcggagaattttgaccgcacttcggcgatttcaaatcttatgttgttgttcctcttgccttcccctgctttgcgagggaaggtgcccgaagggcggaagggggcttaggatataaatcccccctcagtcttcgcgccagctcccccgtaaacgggtggagccaagggatcagcaccatttatagtaatcagtgattactcttcgtctaactcgatatttaaaccaagtgagcggatttctttcataattacgttgaaagattccggtgtgcctggctccatatgttggttgccacttacgatatttttatacatcttcgtacgaccattcacatcatcggatttcacagttagcatttcttgtaaggtgtaggctgcaccatatgcttcaagtgcccatacctccatctcaccgaaacgctgaccaccaaattgtgccttaccacccaatggctgttgtgtaacaaggctataagaacctgttgaacgagcgtgcattttatcatcaactaagtggttcaattttagcatgtacatataacccacggttactggacgttcaaatttctcgccagtacgaccatcgtaaagggttatttgacctgaagttggtaatccacccagttttaatagctctttgatttccgcttcgtctgcaccatcgaacactggcgttgcaactggtaagcctttacgtaaatttcccgctaaacgcaatacttcttcatcagtaaaggtgcttaaatccactttttgtgaaccattacctaataaatcgtatgctttttggatatagctacgtaatttttccacttcttgtttttgtttaagcattgcattgatttgatcaccaataccttttgccgctaaacctaagtgagtttcaaggatctgaccgatgttcatacgagacggtacgcccagtgggtttaatacgatttcaactggctgaccattttcatcgtatggcatatcttcaactgggttaattttcgagataacacctttgttaccgtgacgacccgccattttatcccccggctggatttgacgtttcactgcaaggtaaactttcacaacttttaatacgcccggtgcaagatcatcgcctttaatgattttcttacgtttcacttcaagtttatgttcaaactctttacgaagttcttcgtattgctcagcaagctgttctaattggttttgtttttcttcatctgcaatggtttgttctaaccatttagtgcgatctaatttatctaattgcgccgcatccgcaccactagaaataagaagattacgcacacgagcaaataaaccagcttctaaaatctctaactcttcagttaaatcttttttcgcttcacgaagttgcatttcttcgatttctaatgcacgtttatctttttctacgccgtcacgagtgaagacttgaacatcaataaccgtacctgatgtaccatttggcacgcgtaatgaagaatctttcacatcggaagctttttccccaaagattgcacgtaacaatttttcttctggggttaattgagtttcgcctttaggggttactttacctactaagatgtcgccacctttaacctcagcgccgacataaacgataccagattcatcaagtttgcttaacgctgattcacctacgtttggaatatccgcagtaatttcttctgcacctaacttagtatcacgcgcaacacaagataattcttgaatatggatggtagtgaaacggtcttgttgaacaacacgttcagaaactaacattgagtcttcaaagttatagccgttccaaggcatgaacgctacgcgaatattttgacctaatgcaagttcccctaaatcagttgaaggaccatctgctaatacttcgccacgattaattggatcgcctaaattcacacaaggaatttggttaatacaagtattttggttagagcgggtgtatttaattaaattataaatatcaataccagcttcacctgcaatggtttcatcttcatttactttaatcacaatacgagacgcatcaacgtactgaacggtaccaccacgttttgcaacaaccgcaacacctgagtcaagtgcgattggtttttccatacctgtaccaactaatggtttatccgcacgtaatgttggaactgcttgacgttgcatgttcgcacccatcaacgcacggttcgcatcgtcatgctcaaggaatggaattaatgcagccgcaacagataccacttgttgtgtcgaaacatccatatagtgaatatcttcaggtttatataaaccagattcaccacgttcaccacgagcagtaacgaaagcatcagtaaaacggttattttcgtctaagtttgagtttgcctgtgcaatgatgtagtttgcttcatcaattacagataagtattcaatttcttcagtaacttgaccatcaaccactttacgatatggtgtttctaagaaaccataatcattagtacgtgcaaaagcagaaagtgagttgatcaaaccgatgtttggaccttcaggggtttcaatcggacataaacgaccatagtgagtattatgtacgtcacgcacttcaaagcctgcacgctcacgcgttaaaccgcctggacctaatgcagaaatacgacgtttgtgtgtcacttctgacaatgggttgttttgatccataaattgcgaaagctgtgaagaaccaaagaattcttttactgccgcagaaatcggtttcgggttaattaagtcttgtggcgtgatcgcatctaaatcgcctaaagatagacgttctttgaccgctctttcaacacgcactaaaccgatacggaattggttttcagccatttcgcccacgctacggatacgacggttacccaaatggtcaatatcgtctacttcgccacgaccattacggatgtcgatcaatttacgcattaccgcaataatatcttcattgcttaaaatacccgcaccttccccttctggaaaagctaaagaacggttgaacttcatacgacctactgtagataaatcataacgttctgcagagaagaataaattattgaataacgcttctgaagattctggtgttggtggctcgcccggacgcatcatacgataaatttcgtaaagcgcactagttttgtcataagttggatcgacacgtagcgtttcagaaatatatggaccgtaatctaaatcattagtaaataaagtttcgatcgtggtgtaaccagcttgtgctaattttgcgagggtttctaacgaaatttcgccatttgcaggacaaataatttcgccagactctaaatcaacataatctttcgacgcaactttacctaaaatatattcagaaggcacaaccacttgtgagatattatctttttctaatgctttaatgtgacgagcagtgatgcgacgaccacgttcaacatacactttgccatttgcttcaatatcaaaagaagccgtttcaccacgtaaacgttctggcactaaagtcattaacaatttatcgccagcgatttcaaaggtaattttatcaaagaataagtttaagatttcttcagtggtgtagcctaatgcacgaagaatgattgttgccggtaatttacggcgacggtcaatgcgcgcaaataagttatcttttggatcgaattcaaaatctaaccaagaaccacggtaaggaataatgcgtgcgttataaagcactttacctgaagaatgggttttacctttgtcagaatcaaagaatacacctggactacggtgtaattgtgaaacgataacacgctcggtaccattaattacaaaagtaccgttatcagtcattaatgggatttcccccatataaacttcattttctttaatatctttaactgcgcgtgaagaagattctttatcgtagctcactaaacgtaattttacacgtaagcctgctgcataagttgagccacgaatttggcactcacgtacatcaaactctggctcttctaaacgataatctacatattgtaattctgtatagccattattgcttacaataggaaatacagaacggaatgccgcttctaaaccttgctgaccttcaggatctttttgaataaatttatcaaaagaatccaactgaatggttaataaataaggaacatttaaaacttgcggacgtttaccgaaatctttacgaattcgttttttttcagaataggagtaacccattggttttcctctgctaactgttcagtgacctagccacaaactaactgtgacgtgaatgaccgttaaaatgaccgcactctgaaccttacttctatagtggggtgacaactcaaattacatagaacgacaacttgagcaaaacaacgacaaataacggtgaatttgtcattgtgtggatgtgctttctatcaaaaacacggttaaattaagcaataaaaggtcaagattgattaaaaatcaatctaaatctttgctaattttaaggcggtaaattttaaatgaatgcagctttctcgtcaagtttaaaacttatatagaaattttatgaaacaaaaaaaccgcactttcaaaaagtgcggtttaaaatctatcaattctttaaattataaagaagcttgatcaacagcaacacctgcacccatagtggtagagatgcttactttcttgatgaaaatacctttagcagtagttggttttgctttatttaaagcagccaataatgcttgaagattttcttttaattgaacttcagagaagtttgctttaccgatagtggtgtggatgataccgtttttatcattacgataacggatctgaccagatttagcatttttaactgcttcagcaacgtttggtgttacagtaccaactttagggtttggcattaaaccacgtgggcctaatacttgacctaattgaccaacaacacgcattgcatcaggagaagcgataacaacatcaaagttcatttcgccttttttgatttgctctgctaaatcttccatacctactaaatcagcaccagcttctttagctgcatctgcgttagcaccttgagtgaacacagctacacgtacttcacgaccagtaccgtgtggtaatacagttgcaccacgaacgttttggtcagatttacgaggatcgatacctaagtttactgcaacatcaacactttcaacgaatttagccgttgcgaattgttttaataccgcaatcgcttcgttaatttcgtatgctttagtagaatctacgccagctttgattgctttcatttttttagtcaatttagccatcgtattattcctccaccactaagcccattgaacgagcagtaccagcgattgatttcattttcgtttcgatagtcgcaccagtcatatctgctgctttagtttcagcgatttgacgaacttgatctaaagttactttacccactttatctttgttcggtttaccagaaccagatttgatacctgcagcttttttcaataatactgctgctggtggagttttagtgacgaaagtaaatgaacggtctgcatatacagtgataacaactggaattggtaaacctttttctaagctctcagtacgagcgttgaatgctttacagaattccataatgttcacaccttgctgacctaatgcaggaccaactggtggtgatgggttagccataccagctgcaacttgcaacttaacataggcttggactttttttgccattttagttttcctctaattgggtaataacgctattaaatagctccccgataatttttagtgcaagattcattgcaccacacaaaaatatgagccacaaacggctcataatgggcacggattatataaaaagtgcggttgtttttcaagcacttcttaaatccgatagaagatattatagtgcatcaccaattaatactgaatctaacgcaatttcaatcatatcattgaatgttaattgacgttcttctgccgtggtttgttcgtgagtacgaatatggtcagacacggtacaaatcgttaatgcttttgcaccatattctgcagccacaccataaattccagcagcttccatttccacacctaaaatgccgtatttttccattacatcgaacatttccacatcgggtgtatagaataaatccgccgagaataaattacctacacgaacgactttaccttttgcttttgcagcttgaacagcggcttgtgccatatcaaagtcagcaatagctgnaaagtcgttatctttgaaacgaatacggtttacttttgaatcagtacatgcacctaaaccgataatcacatcgcgcactttcacgtccatacgaacagtgccacaagaacctacacggataatttttttcacgccatattcagtgattaattctttcgcgtaaatagagcaagatggaatccccataccgtgccccataatagaaattttacgacctttataagttccagtaaaaccaagcatattacgaacattcgttacttcaacaacatcttgtaaaaaagtttctgcaatatattttgcacgaagtggatcgccaggcattaaaacaacatcagcaaatgcaccttcaggcgcgttaatatgtggagtcataatttttccttatttttaataatgaataaaaatgaataaagtgcggtcattttttaccgcactttttaattgattaagataaattaaagtgctgcagcacctaagccgataaataaaccagcaatagttgcactcattaagttagcgagagtaccagcgataacggctttgatacctaaacgagcaacatcactacgacggcttggtgccataccacctaaaccaccaattaagattgcaattgagctgaagttagcaaaaccacaaagtgcgaaagtaataatcgctttggttttttcagttaatacaattgcagaatctggttgtaaatattttgcaaattcaagataacccacaaattcattaaccgctaatttcatcccgatcatttgtcctgcaatacctgcttcagcaccatcagttacaccgattaagtatgctaatggtttaaaaattaaaccaaagatagattgtaaggttaagtcgccatagccgaaccatccgcctacgccacttaaaataccattaattaatgcaattaaaccaacgaatgcgattaacattgcacctacgtttaacgcaagttgcatacctgcactcgcaccgcccgccattgcttcaagtacgttagttggtttttctgaatcattgtcttctggttgtttatctgtgaattgttcggtttgtgggaacattaatttcgcaaataataaacctgctggtgccgccataaatgacgcagcgattaagtatgtcaatggcacgcccattccagcataacctgccattactgaacccgcgatagacgctgtaccacccaccataatggcaaataattcagattgggtcatatttttaatgtaagggcgaacaactaatggtgcttcagtttgaccgacgaagatattcgccgccgctgacattgattccgcttttgacgtacccaatgctttttgtaatgcgccacctaatactttaatcacgacttgcataatgccgagatagtaaagcacagaaattaagccagagaagaacacgataatcggtaatactttcactgcaaaaatgaaaccggatggtttacttggatctgccaatccgccgaaaacgaaattaatcccgtcattaccataggcaataacattggataccatatccgcagcggcacccaacgcttgtttacctgctggcacatataaaataagggcggcaaatcctacttggattgctaacgcccctactacggttcgaatactaatcgctttacgattattagaaagtaacacggcaatagcgattaatacgaccattcccaaaatgctgcttaacacactcatttgattcccctagattagttaagttaataaaattcggcttattctacttgttttcttatgaaaagtcggcgaattttcaccgcactttttgtaaacgtctataaaatagtcaaaatcttgttaattccacattgacgcgcataagcagatagcgcattagtttcttccacacttgggatatacgctgataacccagcttcatcacgtacgcctttgctatgcacgcggataatttttaatgccacatcaggataatttcgtagtagttgagcaactttgcccaccaaatgttcagcatcaaaaaaatgctttaaaaaaaccaaccgcacttcttccactttatttaatggcaacaaggcagctaaattttgcaaattccgctccagtttatcgttttttatatgtaaacgttctggtatcacttgctgtggtacaatacctgcttgatttttccgatcaaaacaaagtgtttgcaagccaatgccctcgcctttgagatcaaataaaaatttgtcagtgacatcaattaacgaacaaacacgatcaaactcaaaaaagccactgctatccaaataacaagtcaatccttgcgaacgtaaagccttaaagagtggcacaagttttttgtgatgaatagtgggttctccaccagaaaccgttacaccgcgaataaatggaactgcctccataacctgttcatacaaatactgcaaactgaccaatttcgcactttccgtataacgaggtatggtttccggattatggcaatacaagcaatttagcttgcaaccttgcagaaaaatactcgaacgattgccttgcccctctacatttgaaaacggaataatccgatgtaacggcacaaaaatctcagaaagtgcggtcatttttctaattatttttcagcgatcacatctttttcatcgcgtaattggcgatcaaacacattggcacattcatccgtacccgagccataccaagttgtatcgcgtaatgcgacttcgcctttacggtatttttcaacttcgcttttcttcactagataacctgtaacacgaattaaatccgtgtttttcaaataggtggtaatgtagcgatagcctaaggaaaatgcaccatcaataatatccaccaccgcatcgcagtgatctacataggtttgatcaaaggcaaataaatcccctgtaccagatgggaaatatttatggaaaggtgcagattgtttcaaatgtgcaagtagcgttggttcttcacctacacgaatacggtgagccggtgcgttgcgtttgtcttcttcgtggttacttgcgcccacttgtgcgtgtaataaataacgattgccagtacgttcggcataaactccttcgtgcgcatcagtaatttctttcaatttatccataatcgctgtcgcaatttcatcgccacgaacgctcttaccaaaggtttcatttaagccttcacattgcaataagtgatttgtggcatcagccaagcccacaatcgcaaacattcctgtaaaattagtgcgtttgataaagccctctttttcgaggaatgaactgttaaagaaattactttcttccactacaaatttgtggcgtttatccatggttgaaagagcacatttcgccacacgcggtaataattcattcagcatttcatccgcacttttacaggtgcgagcaattgtccctagacgtaaacgcgttaaagtgtaggcaccgccacattcaggcagtgcgttatagcaacttgctacgccgtattcttcgcctagatcggaaatatagtaagcatcgtttgcaaaagatggtttagaaaccaacaaacaggcttttgctgcaagttcagcaaactcacggcttgttttcgatttgtcataacgaatagtcatattcggtgttggtgcttcaagatcaatcacggcgcgtaaaatcaagcgacctgctttcgtatcataaggcccaatattggcatgacagaatgaatctggcacagttttatcaatatgatttaagaaacgtttaatttttatgtaatctttttcttcatcagtaatgaacggttcgagcaacacatcaagacgcccaatataaacaggataagtcgtaatggatggcacgtgggagtaaagaatcaataatccatcaagtgcctcatcaagatcttttggaggaggcaactctaaaaattcgcagcctttttggatatacacattgtaatcaggcaggatataacgaggacgataaatcgcgtagccttcacataaatcacaaatcatttgattctgtaaaaagccccattcttcatcggtataaccaagcaaatcgcgaggatcaaataaacgctcggcaatattgcctaatgtcattaatttttgatgataagttagattattggctttaaccgtatcgagaatatcttgaagtgaagctaacataacgtcccctttgaaaatggtttcgtattgtacgcaatggtaacaaaatagacaattttgaaaacgtgaggaagatcacagttttagaaaataaacattatgcaaacggttactcaaaataaatatgtttttgatataaatgaactgacaaaattatttctgtttttgcatctttccttttatgataaaacggaatataaaaggtaataaatatgaagaaaaaagtacgcgttatacctcgcacatcttgggctgccacatcattatggacagcgcaatataaaaccatttcaatcttactttttgctctttctattttaggtattggagatgggcttattgtattatcaggtttaggatcgacaccttggactgtactttcacaaggtatagcaatacagacaaattttgatattggctggtcatcttttttaattagttgcgcagtaatgttggtatggaaacctctcaaattacgccttgggcttgggacattattaaatattatcgttattgctctatttctagggatcacaacaaaaatactggcaccgccaaccgcacttttttcacgaatgatcttctgtctgatcggtatattactctatggttttggaactgccttatatctcacttgtcacttaggtgcgggccctcgagacggattaatggttggtatttgccaacgttttcatttaagcatcaacgtggtacgctcaagccttgaaatctcggtttgtttacttggttttttacttggtggtgtcgttggcttgggtactgtccttttcgccaccagcataggcagcgttgttcaattcttcttaaatattattgctcgtttgccacatattccgtatgaaaagtgatatttcagctaacgcattgtctattgaaattaactctaaattcatttgagactcttttcctgcgggtgggcaaaatgcaatatgtttatcgacatcattaatgggtttccaacgtctcggctgagaagaacgactatttggataaaacccgatagtcggaatattaaacgcactgctcaaatgcaatggcccagtagatcccgcaataaataaatctgcacaagccaaagaatgagcaaaatccactaaacctttattcttatcgtaaatggctacgcgtaaatcattcacaagatttgctaattcataggctttttcactttcgccaggccctgcagtcagcacaacattgcaatcaaactcagccaataagcctttaattaaatccgcatattgcgctaaagaaagattcgtagctgaaccaccagaaccgctatgcacaaagatccattttttatttgcggaaagccctaaattctcttgtaaaaaaacgcgctgattttccaccgcacttttctcaaagattaaataaggcggtttaggttcaacaactggcatattatgcttttgcaaaaaagtgcggactaaatcttgattgtattccgcttctgatttttcagaacgagaacggcgttgtgttagacggtgattatagagaatttgaacccatttagtcgcaggcgcaaggcgatatttaattccacttttccaagcgagttttccattatgggtattggaaaagaaactaatcatgccatcaaactgctgcgctttgatttcctgcacaagacgtttgaaatccgttttgtcattttttttgctatcaataataacatgatcaataaatggacaaatttccgctaaagacgcagtgtaactcggcacaagtgcggttaattttagctttggatttgaggctttcaacattgcaaaagcaggccatgcttgcataaaatcgcctaatttatcgttacgaataactaaaatcttttccataatttctccgctaaaataaaaaaaccgcacttgaaagtgcggtcgtattttatgttatttttgtggattataaaacatcaacacaatttaagtcttcgaaagattgctctaagcgtttagacatagattcttccattttacgtaaccaaacacgtgggtcgtagtattttttgtttggtgcatctgggccttcagggttacctaattgaccttgaagatatgcttcatttgctttatagaaattcaaaataccattccaagatgcccattgcgtatcagtatcaatgttcattttgattgcaccgtagccaattgcttcgcggatttcttcgcggctagaacctgaaccaccgtggaatacgaaattaattggttttgcaggaagattgcgttctttagaaacgaactcttgtgattcacctaaaatagatggttttaattttacattacctggtttgtaaacaccgtgtacgttaccgaatgcagcagcaacggtaaagttagggcttactggatgcaattgatcgtaaacataaagcacatcagaaggttgtgtatataaacgtgattcatcaacatcagagttatcaacgccgtcttcttcgccaccagtaatgccaatttcgatttcaagggtcatccccattttatccatacgagcgaggtattcacgacagattgccatattttcttccattgactcttcagataaatcgatcatatgtgaagagaaaagtggacgacccgtttcggcaaaatgtttttcgcctgcatctaataaaccgtcgatccaaggtaataattttttcgctgcgtgatcagtatgaagaataacaggcacaccgtattctttcgctaaagtatgaacctgtttcgctccagcaatcgcaccaagcacatcaggacgagtaccactcgttggtttgatacctttacctgcgtagaacgctgcgccaccatttgaaaattggataatcactggtgcttttacgcgtgcagcagtttctaacacggcattaacggagtctgaacccacacagtttacggcaggaatagcaaagttatgctctttagcataagcaaaaactttttgcacatcttcgcctgttacaacaccgggtttcacaatatctaataatttagccatacttgtgtttcctttttatgtttagcgggataagcccacaatttgaagaatttgtattgatgatggcatttttgatgccaccatcaatatgttatagaggaaaagtgcggttagtttttcgcacgtttttcaagaatttctactgcaggtaatactttgccttctacaaactctaagaatgcaccaccacccgttgaaatgtaagaaatcttatcagcaataccaaataaatcgatagccgctaaggtatcgccgccaccagcgatagagaatgcatcgctgtttgcaatggcgtgagaaatgatttcagtccctttacggaagtgagggaactcaaacacgccaactgggccattccataaaacggtttttgcatttttgataatttcagccaattgttctgctgatttatcgccaatatcaaaaatagattcatcatctttcacttcatttaccactttttctgttgcagctgccgtttcagagaactctaaacctacacgcacatcaactggaactggaatatctgtatttgcggctaattctttcgcaactggaattaaatcagcttcatataaagatttacctacattgtgaccagctgccgcgatgaaagtattcgcaatgccaccgcccacaataatttggtcagcgatttttgaaagagaatttaatacttctaatttagtggaaactttagaaccaccaacaatagccaccattggacgagcaggttcttttaatgctttacctaatgcatctaactcagcggctaataatgggcctgcacaagcgatcggcgcaaattctgcaacgccataagttgatgcttgcgcgcggtgcgctgtaccaaaggcatccattacaaatacgtcgcaaagtgcggcatattttttacctaattctggatcatttttcttttcgcctttgtttacgcgtacgttttctaaaacaacgatttcgccatctttaacatccacaccatttaaataatcttgttctaaacgcacattaaagcctgcgttttttaagtaatcaacaactggttgtaaagaatcttctggtttgaattctccttcagttggacgacctaagtgagaagttaccatcactttcgcacctttttctaaggctaattttaaagtaggaatggtcgcacgaatacgcgcatctgaggtcactttgccatcttttactggcacattaagatctgcacggataaatacacgtttaccggctaaatctaaatcggtcattttgattactgacataatctatcctcttgttaagttaaaattaaaattaaaattgaaaacttttcgtattatacctacttcgtgctaggttgtaacgatttagatcaaagaaattcttatttgctttggcaattcattacctgccattttttatcataacaaataaataattcatttcgactagccctcaaatacgcattttttaattgtggattatgttgcttcatccaaccaaaaagttcatctctacttaatttttgattcggtaattttaatgcgttaaataattcctgctccttagcaaaatattgctgggcagaatcaaaggcgcaactaccgtgtttttcccattcgccttgcaataatttctcgcccggagaaatcgccaaatattgtgctaataaaccttttggcaaggcgggtaaatcgcctttgcaaaaacgaggatgatctgaaacagcgcgagcatttgcattttgtggccatagcccatgtacaacccaaccaaaagtgcggttatttccacattgatattgagaggaataaggcaactgatcgccatatttttcacgctgaatatcacaaaatccaggcgaccaagataatgccaacatataataatcgacaggtgcctttgcattttgcccaatatgatcattgcgcataatcacatcatagtttgcaaaaacatctggattttttaccgcacttttttcaatatccgtccgctttgtctcaaattgaggctcgaatttaggttcaaatttaggctcaaatttaggctcaaatttaggctcagatacttttgtttgcttcgtctgctcaattacgggcgaagatgattgatgtttagttttggttgtatcggtaaaatattgccaaattgctaatataacgagaacaataagagaaagaatggaagtaagttttttcataaattttgtttagtttttgtcaatcaagtttttgtcggctataattcgccgctttcaactctctattaaggatcacaatggcattactcatcactagcaaatgtaccaactgcgatatgtgcttgcctgaatgcccaaacgaagccatttccattggcgatgagatttatgtgatcgatcctatactttgcacggaatgtgtcggccattacgacaccccaacctgccaaaaagtttgcccaatcactaactgtattaagcccgatcctgaacatcaagaaaccgaagaacagctttgggaacgctttgtgatgattcatcattcggataaattgtaatttttaaagcaactgaaatatgacttattatcttctaaaagagtgcggttaattttgagcttatttttattatcaaaaaacgaaatttttcaccgcacttttatctataaaaagaactacattgagttacttttcttcacattaccccgccaccactggtaaatatccccattgaattaaaaatggaatgagcataatcacgacgccaattaataacgcaagcaccaaagcaaaattaccgccagcgactcgatatggcaatgttggattttcaatacgtgtacgccatgccaagctaattggtaaaattaagcaatagaacgcacacaacaaaccagcgtaacttaatgcagtaataaatccttcaggataaaacaatgcaaatacaagtggcggtaaaaatgcggcaatggttaatacaaagcgattatttggcaaatgataacgcttgaataaatcccccaatccctcaaatacaccaagcattacgcctaagaaagaagtgatcagtgcaagtgatgagaacacacgcacaacctctcccataaaatgagaacctgtaatttcacgcgttgcattcactaagccatttagcgttgggtcagcttgtaaaatacgcacaaattcactttgacttaatacaccatgagttgctaactgccatacaaggtaagcggctaatggaatcgcagtaccaatcaaaatggcacgacgaaatttatcaacacttccacctaagtagctattcacactcgccataataacgtggaaaccgaaagaagttaaaaatattggtgccgcagaaaccacaaaagcataatccaaaggcaatgccattaaattatctgttgctacttttggaagcatcataaacagcacaaaagcaaaggcgattaacttaccaataaataacacgcgagttaagccatccacgcctttcgttcctacaaccacgaaagaacctaataccaccgtaaagataataatcgccgttttaagcgacatcgcttccattccaaacgcagttggcaagcctgaaagtaaagatccaccaccagtaatataagcggctgaaagtgcataaagtaaaactaacaaactcaacgttgcgaaaattcgcccaggaaccccaaaatatttttcagcgagcgtggcgacaccatcatccaactgatccgctgtttgatacacttctacaaacaacaatccgctgtaaaccaacaaagcccacaagccaacgagcaataacagggtataaccaaagcccatacctgctgatgtaagcggcatagcaagcatacctgctccaatggttgtgcctgcaataatcagcgcactcccaaaagttttgttttttagcataaaattgtccttataatgttgtgtttaaaaactaatttaaatttgaccgcacttttctttatagtgtaaacggcaaacagaaagataagaatcattgcctccaatttgaatttgtgcaccttctttaatgacctcgccctgatcatttaaacgcaaaacaaaattagccttgcggccacaataacaaattgtttttaattcttcgagttgatccgcccaagccagtaaatatttacttccttcaaaaagttccgcttggaaatctgtacgcaagccataacaaagcacagggattttgagtttatcaacaacatcactcaactggtaaacttgttgtttgctaagaaattgagcttcatccaccaacacgcaatgcactttttctttttttaaatgctcattaatttcatcaaacaaattggtttccgagcgaaataaaaaggcatcttgcgaaatgccaatacgcgatgtgacttttcccacgccaaaacgatcatcaatcgcagccgtataaactaatgtgttcatatcacgctcacgatagttataggaagattgtagcaacgtcgttgattttccagcgttcattgtggagtaatagaagtagagtttcgccattttttctcctaaattgccggtaattccgccattgcccaacgaggtttaacatcaatagccagatcgctatgctgaccttgttttaaacgtaaaaaacctgtgtaagcaatcatcgcaccattatctgtacaaaattgaggttgaggataaaacacttcgccacctaaattttgcattaagtgcgcaagcgtttctcggagttttttatttgcgctcacccctcccgcaatcactaaacgtttatagcctgtttctttcaatgcacgcttacatttaatggcaagagtatccaccaccgcatcttggaaagcataagcaatatctgctttagtttgctctatcagttcgccctcgtttttaattgcttgattaactgtatttgcggcaaatgtttttaaaccagaaaaactaaaatcaaggcctgcacgatctgtcattggacgtggaaatgtgaaacgatttggcgtacctttttccgctaaacgagaaagtgccgcgccacctggataatctagtccaagtaattttgctgttttatcaaaggcttcgccagcagcatcatcaatagattctcctatcacttcatattttcctacaccatcgacacgcactaattgagtgtggccacccgataccaacagagcaacaaaaggaaagtgcggtgaattgtcatcaagcattggcgcaagtaaatgcccttccatatgatgaacaccaatcgcaggaacattccaagcataggctaaagaacgtgcaatcgtagcaccgacaagcaatgcgccaacaagcccagggccactcgtataagcaataccatcaatatcgctcgcggttaaattggcttcctctaatgccgctttaataagaggtgctgttttccgaatatgatcacgtgatgctaattcaggaaccacaccaccataatctgcatgcagggcaatttgagtataaagttgattagcaattaatcctttttcttcatcataaatcgccacgcccgtttcatcacaggaagtttcaatgcctaagattttcattgattttcttaatttattacctaaaatgttgcgcgattttaccctgtttaagcggttttaaccagttgaaaccacaaatattaaggtgaattggcattctatcctttactttttccctaaaaatagattagaattgcgtcctttattaaatttgtcatttacacacaggtgctttggcaaaaataaaattttaaattgcaattaaattaaactcattgaggtgattggcttatgcctgtaattaaagtacgtgaaaacgaatcatttgacgtagctttacgtcgtttcaaacgctcttgcgaaaaagcgggaatcttagctgaagtacgcgctcgcgaattttacgaaaaaccaactacaattcgtaaacgtgaaaatgcaacacttgcaaaacgtcacgcaaaacgcaacgctcgcgaaaacgcgcgcaatacccgtttatactaatttatagtattttctgactcgagttaagacaaaccgtgaatcctttggactcacggttttgttactttaagcacaacaaaaatctacgccaaaaacgaccgcactttcacaccacgatcacggaggctcgacaatgaaaggttctattcctcgcccctttattgatgatttgctgacaaagtccgatattgtcgatgtgattaacacgcgcgtaaaactaaaaaaagctggccgcgattatcaagcctgctgccctttccatcacgaaaaaacaccatccttcacagttagccaaaagaaacagttttatcattgctttggttgtggcgcacatggtaatgcgatttcctttttaatggattatgacaaacttgaatttatagaggcgattgaagaacttgcagcaatggcagggcttgaaataccttacgaaaaacgcgttaatcacagcggaaaacctcaagctaattaccaaaccaaacgaaatctctatgaattaatgcaagagattgccacgttttatcaaaaccaattaccattaaatactcaagcacaagaatatttacaacaacgtgggctttcacctgaaattattgagcgtttccaaattgggtttgtgccgaatgcaatggatactgtactgcgtaaatttggtgttaatcgtgaagaacaacaaaaactcattgagttaggcatgctttctcgaaatgatcgtggcaatatttacgataaattccgaaatcgcatcatgtttccaatccgcgataaacgtggtcgcacagtggcttttggtgggcgtgtattaacagatgaaaaaccgaaatatctgaattcgccagaaaccattacttatcataaaggtaaggagctttatggtttgtatgaagccttgcaaaccaacgatgaacccaaacaattacttgttgttgaaggttatatggatgtagtggcattagcacaatttggcgtggattatgcggtcgcttctttagggacatccacgacatcagaacaaattcaacttattttgcgttcgaccgaacaggttgtttgttgttacgatggtgaccgtgcagggcgtgatgctgcttggcgcgcactagaaaatgcgttgccctatttagaagatggcagacaactcaaatttattttcttgccagatggagaagaacctgatacttacattcgtcaatacggcaaagaaaaatttgaagaatacatcgaaagtgcgcaatctttaagcgagtttatgtttgcacatttaagtcctcaggttgatttttccactaaagaagggcgtggaaaattagttgcgctasstgcgccgttaattcaccaaattccaggagaaatgcttcgcttatcgctacgcaatatgcttgctcaaaaacttgggatttttgatcaaactcagctggaaaatcttattcccaaaaaattagaacaagccaatacacaacaaaaagtcactcataataagatcaagaagacaccgatgcgaatggtcatttcattgcttatgcaaaatcctgagttagtaaaacgtatgtctgaaagcggcgtgcaagcattacgtgcggaagcagggtttgaaattctggaaaaattgaccgcactttgtcgccaacgagagggcattactacggggcaaattttggaatacttccgcaatacatcttacagtaatccccttgaaatactggcgacttgggatcatttattggacgaatccgacataatcaacgcattttctcaaaattaccgtcgcttaaatattcaagctattgagcgcgatattgaaatgcttattgctaaagaacgaacagagggtctcactaatgaagaaaaaacggtacttgtacatcttttagctggtaaagnacagcagnaaaaacagttagtgaatccgctataacaatggtagaatctcaagttcataaaaaatcttatcttctcaatcacatcaagcaaaacgagtataaaaatggaaaaaaatcaacaatctacggctgaacaatattcagaacaaattgagcaattgatggagctaggtcgtacacaagggtatttaacttttgctgaaatcaatgacttattgcccgaagatgctattgatcctgaatattacgacaaattgctacaaacgttgcaaaatgatgctggtatccctgtattagatgaagcaccagaaagcgatgatatgatgttgagtgataccatccctgatgaagatgcagtggaagaagcaactcaaattctttcaaatgtagaatctgaaatcggtcgaacaacggatcccgtacgcatgtatatgcgcgaaatgggaacggtggatcttcttactcgtgaagatgaaattagcattgcaaaacgtattgaaggagggattgatgaagttcaaacctctatctcagcctatcctgaagcattaaatggattactaaaaaattatgatgatgtagaaaaaggtaatttccgtttgaccgatttaattacgggttttgttgatccaaatgccgaaatagaagaacacaacggacttgatgaagacttttctgacgaagatgatgaagaagaatctagtaatgcagatgtggaagacaatgaagatgaagaagacaatgaatcagaatctacatcagattcaagcgactctgataacagtattgatcctgaagttgctcgcgaaaaatttcagcaattaagagaacagcactctaaaacccttgctgttattgaaaaacacggtcgctctggaaaacgtgcccaagatcaaattgcactacttggcgaaatttttaaacaattccgtttagtaccaaaacaatttgatttactcgttctatcaatgaaagaaatgatgaaacgtgtgcgctaccaagaacgtcagctacaaaaaatattagtggatatagcaggaatgccaaaggatgattttgaaaaaattattaccactaatggcagtaacagtgaatgggtagcaaaagcattaaaatctagcaaaccttgggctaaacgtttaattaaatatgaagatcgtatttatgaagccttaaacaatctagcgataacagaagaaaatactaaacttaccattactcaaatgcgtgacatttgcgatgcagtcgcacgaggcgaacaaaaagcacgtcgagctaaaaaagaaatggttgaagctaacttgcgtttagtaatttccatcgcgaaaaaatacacaaatcgaggtttacaattcttagatttaattcaagaagggaatatcggtttaatgaaagcggtagataaatttgaatatcgacgtggctacaaattctctacatatgctacttggtggattcgtcaagcaatcactcgctctattgcggatcaagcgcgtacaatccgtattcctgtgcatatgattgaaacaatcaataaacttaatcgtatttctcgccagttgttacaagaaatgggacgtgaagcaacaccagaagaattggcagaacgtatgggaatgccagaagataaaatccgtaaagtactgaaaattgcaaaagagccgatttctatggaaacacctattggcgatgacgatgattcgcatttaggggattttattgaagattcaaccttagaacttcctcttgattctgccacagcacaaagtttaaaagttgcaactcacgaagtgctagaaggcttgacgccacgtgaagcaaaagtattacgtatgcgttttggcattgatatgaataccgaccatacacttgaagaagtgggtaaacaattcgatgtaacacgcgaacgtattcgtcaaattgaagcaaaagcattacgtaaattacgtcatcctagccgttctgaaacactgagaagttttttagatgaatagagagaaacataaaagaggaaaatcgatctaatcttaaaaaatcagatacatttgtttaaggactaaattctataatccgcagaatttagtccttttacttttacttaaagcaccgcattaatatgcattcaaatttcaactattttagttagataagccattaacatttaacaatggcaacaaatattggttatttaaaccattttaatcataaaaaaatctgcaccccaattagctggtttatttattcagctttaaggcacagattaaagtgcggtaaatttttttgatatttggcgtaaattatttatttaatttcgctttgtaagttggattcattaagttttctacagaaagaatgtcatctaattgttcttctgttaataaacctttttctaacacaacttcacgtacgcctttgcctgtttgtgcacagattttacccactaagtcgccgttgtggtgaccgataaatggattcaagtaagtcacaataccaattgaattaaacacgtagttttcacaaatttctttgtttacagtgatgccatccacacatttatcgcgtaagttcacacaagcattggttaagatatcgatagattcaaacattgcttgaccaatcactggttccattacgtttaattgtaattgacctgcttcagatgcgaaggtcacagtggtatcgttaccaattactttaaagcacacttggtttaccacctctggaacaactgggtttacttttgctggcataatagaagaacccgcttgtaattcaggaagattaatttcttttaaacctgcacgtgggccagaagaaagtaaacgtaagtcattacatactttagaaagtttcactgcagtacgttttaatgcaccgtgaaccatgacataagcaccacagtcagatgttgcttcaattaagttttctgctggtacacaagctaatccagtcacttcagcaagatgttttacaactaattctgtatagccttgtggcgtatttaaaccagtaccgattgccgttgcaccaaggtttacttcaagtaataaacctgctgtacgttttaagttacgcacttcttcttcaagtaatacggcgaaagctttgaattcttgaccaacagtcattggcaccgcatcttgcaattgggtacgacccatttttaagatatttgcaaactcttttgctttattatcaaaactgtcgtgtaaatattgaattttatcgatcaattttaagatgctgttgtacaccgcaatacggaaaccggtaggatacgcatcgttggtcgattggcttgcattaacgtgatccatcggattaatcacgttatattcgccttttttatgaccaattttttcaagggcaagattagcaaccacttcattagtattcatattgacagacgtacctgcaccaccttgatatacgtctgatgggaattgatctaagcattttccagtggtaagaatttcatcacaagctgctacaatcgcttttgcaatatcacttggaattgcacctaattcgccattggctaaagctgttgctttttttaccattaccataccacgcacaaactcaggcacgtcagaaatggttacgttagaaatattgaaattttctaccgctcttaatgtatgaatcccccaatatgcttctgcaggcacatcacgttcgccaagtaaatctacttcttttctaaattgagtcattgtaatcacctttttgggttagttaatttatcgtcattatagaaatttcaagaagaaaaaacttgatgaagatcacattttcaaaaaatgctctcaagacatattttcatttttcggattagttttttwagggaaaaatgttctatctatcaatcttacacagatttcaatagcctaccaattttctcaaataatttctgaatttgcctctgcacgacacccgagtacccgcaccattaaaccatattcattgagttgtgatatgcctatcagtagatctttttcttctgtactttgttgctgcaaggcttgcacctgtngtttgatttccgcattatttttcgccaaatttagataagtcagcgaaccttgatgggaataattttccatctggcttaaagcggtaaggttcattttagacggcagccactggatacaatcactgacaagcggtcgttttttgccatcgttttgcaaagcgtaaatcttcaaatgggaagaaaactgacggaaggcaaaacgttcatcattcaacacccgcccaatcgccacgatttcaccgtaaatcagctcgctttgttcgcccatttcaatctgggtttgctgcttaaaaacggaatctctatgtaacaccaacggatgcggcaaatagaataaacgactgttttccgcaagcaaaatatgggttgtttgcatcgcactgtcgccttcattcatcgcctgcacccgagtaaatgcctgcgtatttaaagaaagtgcggtcaattttgccaatgaaatatcaatctctaacagatcgcccgccagcacgccaggggaggacgacatctgcatcgcattcaagccattcgcccacgcatcatcgtaacttggcaacgttatcactttaaacggtggcgtcgcaaagtattcagcaagctgggttttaccgctggaggaaagtttggtggaaagggataatttgctgttcatagattttgtaggggctaattatattagccccgatatttcaccaataattgggcaaatgtaattcacccctacgattaacgaaccaaagatgcaggttcttccacattcttcaacaacgcatatttttcgatccaaccgatcacgccatccagattttcttttttcatcaggttggtgaaaataaacggctgaccgttacgcatacgacgagcatcacgttccatgacgcttaagtcagcaccaacgaatggagcaagatcagttttgttgatcacaagtaaatctgaacgagtgatacctggcccacctttacgagggattttttccccttgagccacatcgatcacaaaaatcgtcacgtctgccaaatcagggctaaaagtcgctgaaaggttatcgccacctgattcaatgaacacgatttccacatcagggaaacgagtcaccatttcgtccacggcttctaaattcatcgaggcatcttcacgaattgctgtgtgcgggcaaccgcccgtttccacgcccataattcgctctggtggaagcaaactatttttcgttaaaaattccgcatcttcttgggtgtaaatatcgttagtaatgactgctacgctatattttgacgctatttcacgagtgagtttttcaattaacgccgttttacccgccccaacagggccagccacgccaattttaatgtagttacgcataatgttccttttgtttatcatcgtagcaactgtgttgctcatgggtgtaggggcaagttacatttgcccctatatatcaacgaatgttcaagggcaaatgtgatttgcccctacaagtaaaatctcaataaaaaataaccgcacttacgacatataaagtcgcgtataaagcacttcgtgttgcatagcccgaatatcattcgccagcgttgccgcaccaagccattcttcgtcagggtcaaggcttaattctaccgcttgtacgagcgatcctcgcaagtcaaacaaaatatcttgtccatccatttggctgagaggaattagcttcacgccgttagtgattacaccaactgctgcgttgtagtagaacgcatagagcgtatctgctttgcttaaacccatggcttgagcgaccatcgcaaacactattgggaaatagccctgtactcgtttttctgcaatcgcttgctggtaagctgtgagcaacgtatgtgtttcatagcgaataaaaattttcagcaatcgtacgccgagtttgaaactcccttcacgactttcgcgtgccactttggtggcggaaagttgccaatccagttcgcacaagcggtcaaaattcccctcacacattgcatcaaaggcaagagaaagatacgccccgtcgttgtaaatccagttttgtaaaagctgggtttgcacatattcttctagggtcgctttgctttctaccacacgttgctggacgaaggtttccaagccattggaatggttaaatccaccaatcggtaaagttggatcgaccaagtgcaacaacgcacctaaatccgttaaagagcggtttaatgtttgtgccaatgtccatctccgtgatgatgatagccatgatgatcatgcgaatggctatgagaatgtccgtgcccttgtgcagaatttgctcttaacgcttggcttaaacggcgttctgctttttgcggatgaaatcccgcagcttgcagccattcaaacatcggcttatcgtaaggtaatgttacttcatcgccatctaaaaaaagcggcgaatgtttgttgccgatttcataacacgctcgtgccatttcaggcaaggttttcggcgacagcacaatcacgtcactcggtaaaatttcaatcgcaatcactaattcatcgctgataaacactacatcatcgtgtttcaagcgttgcccctcttttagcaagcgaaatgctacttcacgccccgtatttgtagttttacgcaaaatattgcgttcgctttcataccactgcaatgccacgcgttcaatgggctgtgtggtaattttgccctctgcttgaagtgcggttaaatttcccaagatattttctataatagggagaattgggttaattattttcatctttcctctataaatccactttcttctcttcgaaagaaaaactacagctacaatgatttcttatttatcaagtaagaggcgtatcgtacacgcccttttacactaattcgtctatgaaaacagtcctttagaataggaaatatcgctgacccaatggtacgctatccactggttcacaggtaattaactctccgtccactcgaacttcataacgttcagcatcaacagtaatgtttggtgttacatcattatgaaccagatcttttttacctacgttgcggcagcctttcacagcaatggtttctttgtgtaaaccgaacttcgcacgaatatcagctttttcagcggcttgtgaaacaaagaatactgctgtttgtgcggttgctaagccttgtgcaccgtacattggacggtagaatacaggttgcggtgttggaattgaggcatttggatcgcccattttcgcatagctaataaagccttttttaatcaccacttcaggttttacgccaaagaacatcggtttccataacacgatatctgcgattttacccacttctaacgagccaatatgctccgcaataccatgtgcaattgctgggttgatggtgtatttcgcgatatatcgtttaatacggaagttatcgtttccttcattacctagctcaccacgttgcattttcatcttatctgcagtttgccatgtacgaataacgacttcgccaatacgtcccatcgcttgagagtctgaactcataatggagaagacgcccatatcatgcaaaatatcttctgctgcaatggtttcagggcggatacggctatcggcaaaagctacgtcttccggcacgcgtttatctaagtgatggcaaaccatcaacatatccaaatgttcatcaatggtgtttttggtaaacggacgagtcgggttggttgaagcaggtaatacgtttgaatacatcgctgctttaatgatgtcaggtgcatgaccaccacctgcgccctccgtatggaaagtatgaatgactcgtccatcaatcgctttcatcgtgtcttccaaaaagccactttcatttagcgtgtctgtgtgaatggccacttgaatatccatttcatctgctacttttaaggcagaatcaatcacggcaggcgttgcaccccagtcttcgtggatttttaaacctaatgcacccgcttcaatttgctcacgcagaggatctagggttgaacagttgcctttaccaaaaaatccgacgtttaccggcaaggcttctgccgcttgaaacatacgttccatataccatgcgccaggggtacaagtggttgcgtgtgtaccatcagcagggccagttccaccaccaattaacgtggtaacgccactttcaattgcatgttgtgcttgttgtggacaaataaagtgaatgtgggtatcgataccaccagcggttgcaattaaatgtgcaccgttatgaacttccgtgcttgcaccgataatcatatttggtgtgacgttatccatggtgtcagggttacctgcttgtccaatacccacaatacgcccatcacgaataccaatatcggctttgataatgcctaatttagcatcaatgatcatcacgttggtaatcacaaaatccaatacattcggattgtcgcgagttgccgtaccgctttgagccataccatcacgcacgcttttaccgccaccaaatttacactcatcacctttggtcaataaatcttgttcaatggttgcccataaattggtatcgcctaaacggactttatcgccaactgttggaccataagttgctacatattgcgctcttgaaattgttaatgccatcttgccctaccttataatttgccatcaatttgattatggaaaccataaatgatttggttaccaccaaaagcaactaattccactgatttcacttcaccgggttcaaaacgcaccgcattgccagatggaacatttaagcgcattccacgtgccaaagtgcggtcaaatttaagggcattattggtttcaaaaaaatggtaatgcgagccaacttgaattgggcggtcgcctgaatttgttacttcgatttttacggtttttctgccgacattagcgagaatatcgccttcggctaattggtattcgcctgggatcatatctttgttccttgtagggtgggctttagcccaccattgatatttttattttgtgggctaaagcccaccctwcggttatctgattggattatgcacggtaacaagtttcgtgccatcggggaaagtagcttcaatctggacttcatgaaccatttccgccacaccttccatgacatcatcaacggttaaaagtgttgcgccatattgcatgacttccgctacactcattccttctcttgctgcctcttgtaaatgactagcaatataagcaatagtttctggatagtttaatttaacgccgcgtgctttgcgttttgccgcaagttcgcccgcgaggaaaagcatcagtttttcttgttctctggaagttaagtgcatattttcattccttaatttattatacgaaagtcagcgaattttacgtaaaaaatctaaaataggaaaaatattttgtcagaattttttgtaagccccttgaaagaaaaaaaatcctccttatatagaaaccgcacttacaaattattaagaaggaaattaatcatgaatattcgtcctttacacgatcgtgtaattattaaacgtgaagaagtcgaaacccgttcagctggcggtatcgtattaaccggttcagcagcgactaaatcaacccgcgcgaaagtattagctgtgggtaaaggtcgtattttagaaaatggcaccgttcaacctttagatgttaaagttggcgatatcgtaattttcaacgacggttacggcgtgaaaagcgaaaaaatcgatggtgaagaagtgttaatcatttctgaaaacgacatcctagcaattgtagaataattattaaataagggaaaagaaaatggcagcaaaagacgtaaaatttggtaatgacgcacgcgtaaaaatgcttaaaggcgtgaatgtattagcggatgcagtaaaagtaacccttggcccgaaaggtcgtcatgtaattttagataaatcatttggcgcaccaactatcactaaagacggtgtgtctgttgctcgtgaaatcgaattagaagataaattcgaaaacatgggggcacaaatggtgaaagaagtggcatctaaagcaaatgatgctgcaggtgacggtacaactactgcaactgtacttgcgcaagctatcgtaaatgaaggcttgaaagcagtagctgcaggtatgaatccaatggatttaaaacgtggtattgataaagcagtaagtgcggttgtttctgaacttaaaaatttatctaaaccttgtgaaacagcaaaagaaattgaacaagtagggactatttctgcaaactctgacagcattgtgggtcaattaatctcacaagcaatggaaaaagtgggcaaggaaggtgtaattactgttgaagatggtacgggtcttgaagatgaattagatgtggttgaaggcatgcaattcgaccgtggttacctttctccatatttcatcaacaaaccagaaactgcaaccgttgaattagataatccatatcttcttcttgtagataaaaaaatctctaacattcgtgaattacttcccgtgttagaaggcgttgcgaaagcaggtaaaccgttattaatcatcgctgaagacgtggaaggcgaagcgcttgcaaccttagtggtaaacactatgcgcggtatcgtgaaagttgcagccgtgaaagcaccaggttttggtgatcgtcgtaaagcgatgttacaagatattgcaattttaacagcgggtacagtgatttctgaagaaattggtatggagcttgaaaaagcaacattggaagatttaggtcaagcaaaacgtgttgttatcaataaagataacacaaccattattgatggtatcggcgatgaagcacaaatcaaaggtcgtgtggctcaaattcgtcagcaaatcgaagaatcaacttctgactacgacaaagaaaaactccaagaacgcgtggctaaattagcaggcggtgtggcagtaatcaaagtgggcgcagcaactgaagttgaaatgaaagagaaaaaagatcgtgtagatgatgcattacatgcaactcgtgcagcggttgaagaaggtatcgttgctggtggtggcgttgcattagttcgcgcassagcgaaagttgcagcaagcctaaaaggtgacaacgaagaacaaaatgtgggtatcaaacttgcattacgtgctatggaagcgcctttacgtcaaatcgtcactaacgcaggtgaagaagcttcagttgtggcaagtgcggttaaaaatggcgaaggaaactttggttataatgcaggaacagaacagtacggcgatatgatcgaaatgggtatcttagatccaactaaagtcactcgttctgcattgcaattcgcagcttctgtagcaggcttaatgattaccactgaatgtatggtaactgatcttccaaaagatgataaagccgatttaggtgctgctggaatgggcggtatgggtggaatgggcggaatgatgtaattcgcttatacgagtaaaaaatctatcccaacagaaaatttgagccctatatgacttagggctcaaatctactaaaataagggatattttttattaccctattctaaatttatatatgataaaaataaaaaaacccagttttaaactgggttttattttatctattggataaattattctgcaacaacgattacatctaatgccgcaaatacttcaccgtgaagttggaaacgaacatcgtggtcaccaagagtacggattggaccgtttggtaaacgaacttcacttttcgcaattttaacgcctgctgcagttactgcctctgccacatcacgagtagtgattgcgccgaataaacgaccttcatcacctgctttagatgcgatagtcacagaacctaatgcagtaacttctgctgcacgagcttgagctgctgcaagatttgctgctgctgtcgcttctaattctgcacgacgtgcttcaaagtgttcaatgttagctttagttgccataacagctttaccttgtgggattaagaagttacgtgcaaaacctgatttaacatttacttgatcgcccacttgacctaagtgaacaattttatctaaaagaattacttgcattaccgtgtctccttaattactgatgattgtcagtgtatggaagtaacgctaaatagcgagcgcgtttgattgcacgagctaattgacgttggtacttcgcacgagtaccggtaatacggctaggtacaattttgccgctttctgaaatatagttctttaatgtagcgatatctttgtaatcgatttcaacaacattttccgctgtgaaacggcagnacttacgacgacggaaataacgtgccatttggctagtctcctaatctataaattcgatttgctcggcatgtaaaactaattggcataacccactttgggttttatgtgatgtaataaatcccaccaccaaaattttactaccgaccgtaatgctttgagttttttctatcaattgattaccactaatttgaacaggcatttttaaccaagcttgacgtgtgaaaccactttcaatctgatcagaacgatgttctaacaaaaacttgcaatgctcaattccactagggctctttaatcgctttggtaaccgagaaacgactcccataaccgaaaaactattatcaattttcaaattactcttcagcatcctcaaaatcgttgttttcaacttcagctaaaggtttacgttcttctttagccgctttcattggggacgcttcggttacggcgtgcttagtatggataacaagactgcgtaatacagcatcgttataacggaaagtcgtttctagctcgtcgatgacttgttgaggcgcttctacattcataagcacataatgtgctttgtgtaatttattaattgggtacgctaattggcgacgrccccaatcttctaggcgatgaacttgaccaccagcttcttttacagaaccggtgtaacgttcgatcatacctggtacttgctcgctttggtccggatgaaccataaacacgatttcgtagtgacgcattactgctccttacgggttaatcagcctttgacgtrgatcagccaccaatctgcaaaggcaaggaacgaaaaattcaatgtggctaagggttgcggattataccgattttttnacgctccgcaaccagtttgagttctttttgaacaaaaaagaaggtcgatattgtaacaatatcgaccnatctcaaatcttctgtaattaacgactacggaaaataatacgtcctttacttaaatcataaggcgtcatttctacagtcactttatccccagtcaaaatacggatatagtttttacgcatttttccagaaatatgtgcagtaaccacgtgaccgttttccaactccacgcggaacatagtattcggtaaagtctctaaaattgtgccttgcatctcaatgcaatcttctttcgccattgtatcctctaaaaataatcgattttttatccgcactttaggcggaaaagttaagaaaaacgggcggattatagccgtttttagctttctacgaaagaaaaaataatattgttcatgaaaaactcaatttggcataacctaacaatgatttacaaagctaaaacaacccctataataaccgcacttttcttattaaatagtacttatgaactcaaaaaaacacttaggccatacggcgcgtaaacgctttggtcaaaactttttacatgatacttctgtcattcaaggtatcgtggcggcgatttacccacaacctaatcaattcttagtggaaattggcccagggcttggtgcattaacagagcctgttggtgaacttgtcgatcatctgactgtggtagagcttgaccgagaccttgcagaacgtttacgtcaccatccatttttacatcaaaagctcaccgttattgaaacggatgcgatgcaatttgattttggtgcgctttacacaaaagaaaatttagcagaaaaagggcaaaaattacgtgtgtttggtaacttaccttacaacatttctacgccattgatgttccacttgtttaaatatcatgatgtgattcaagatatgcactttatgctgcaaaaagaagtggtaaaacgcctatgtgccgcaccaaatagcaaagcttatggtcgtttaacgattatggcgcaatatttctgccaagtgatgcctgtgcttgaagtaccgccttcggcattcaaacctgcaccgaaagtagattcagccgttgtgcgtttaattccgcataaggaattgccgcaccctgtaaaagatttatattggttgaaccgtgtttgctcccaagcgttcaatcaacgtcgtaaaacattacgcaatgcactctcaactctattttcacctgaaaatctgaccgcacttggtattgatttaaatgcacgtgcagaaaatttggctatcgcagattatgcacgtttagcgaactggttagcggataatccaccagcagatgtcaataaagatgaaatcttagattcagaagagtaaaaataataaaaaggtgtaacccttgttacaccttggctttctacataaaacgaacaatttctttaccttgcatttctttaatacgttgttgttctttccatttttttctatttaaagctcgtataatatttycttttatccgagttaaacgctgtttcaatgtctttttcttacggatttttgaacgtttttgtcgttctttttccaatccgcttgttaatacacttttactttgattcgcttggagttcttgaatacaaattgctggattcagttgatagacaatataattatcaacatcaactaatttattaaaaataagttcatcaactgcaacaatttcatcagaaggaatattctttaaatattcaattacatatttagccgcaccttgagaaataatataacctgccgtcccccagtgagttgattttaaaatatcaaagttcctagaattaaaaggtggaattttagtttgtttctcaagtttaactggctgtaaaaaagtttctaaacgaataataaaaatatcattaaaatcaaaacgtgtttttaaccattcattttggttcaaaaatacttccgcattctcgccaagaattacatcatcttcaaaaattttgagatattcaaaattttcattcacacacttattccataataagaaatggctaattaaacagcctttttctcctttagtaagtattctagattcctctatattatgtaatatggagtttgattgattgattgattgattgattgattgattgattgattgattgattgattgattgattgattgattgattgattgattgattgattgataagtgtacgcattaaagaaactaaatgaaagtttttttgattcaaattgcttagtaatatgtttgcgacgttcagttgcattttccatactaatgacaatattttcaatagcactcatatttaaataaaaatggaaataactaaatttttcgcattctactatacaaaaagaataaatcaacaataaaagtctgtgttaaaattttcaaaatttatttataaaagagcggtcaaaaatggcaacctatttcgtcggtgatttgcaaggctgttatgatgaattacagcttttattagaacgtgtagatttcaatcctacgcaagataaactttatcttgtgggggatcttgtggcgcgtggggataaatcacttgaatgtcttcgttttgtaaaatcacttggtaatgcagcgcaaaccgtactaggcaatcacgatttacatttaattgcgaccgcactggacattaaaaaagtgaaaccgcgtgatcgtgttgatgccatttttaatgcgcccgattttgatgagctgattcattggttacgtcatcagccattacttgtgcataatgaaaagttaaacttcctgatgtcacacgcaggcatttccccagattgggatttgaaaactgcgaaatcttgtgcggctgaagttgaacaaattttacagcacggcgattttcattatcttattgaaaatatgtattctgaacagcctgatcgctggtcgccagatttacagggcttagcacgtcatcgctacattattaatgctttcactcgaatgcgtttttgctatttggatcatcgctttgattttgcctgtaaatcccctttaaaagatgcgccacggagctcacaccttggtttaatttagataatccactttataaacaaattcccattgtctttgggcattgggcaagtttagtggatgagcctactccaaaaggtatttatgccttagatactggttgtgtgtggaataatcgaatgactatgttgcgttgggaagacaagcagttcttcactcaaagtgcggtcaaaaattacagtgatttttaaggaaacgctatgctctcgctcactgctgaatcttgcgaactgttcaacattcctttctaccaattcgcccaaatgaaaaaattctgcccagaagatattccagcgattaaagcggattacaaattacattgggataattggaaagcgataattcaatctgtttcagcacaactcggtacgccttttgcgaaaccgcatattgaaagctggaccaatggttggcaagtgcgggctcatttcttcgcttattttaaatacgagtttaaccaaaattctgccgcaatcttttctgtgctattaaatcgtcgccgactaagagtgtgtttagattggcattgctatcgtgcagatcgctcacaaattaatgtgcaacaatataatcagtggcttgatcaatttgatttcaaacaatttgctgattttgagatttggcgagaggatgaaagtgaatatgatgattttcgccaagtgaaggtcatttctgaaaaaaatctgatcttacgttcagatgaggatttttggtgcattgggaaaagtattgaaaaagccgagttaaatcaaatagatcccgttttatttattacgcacaccattcaacaattacaaccgctttacgatcgctgccatcaataaagtatacccttagtataaataattgagctctacattatgcagagcccaatatttcagcaaattaataaactatccaaatttatggcaacagtttaaagtgcggtaattcttattgatgtttttaactacacatcataagtagttgatgctgtattaccgccacgaccagtccagttagtgtggaaaaactcgccacgaggtttatctgtgcgttcataagtatgagcaccgaagtagtcgcgttgtgcttgcaataagtttgctggtaaacgtgctgaagtatagccatctaagaaagtaatcgcagacgccatacaaggcattgggatacccacttcgatagattttgccaccactttacgccagtcacttaatgcgttttctaaaatgcctttgaagtagctatctgaacctaagaaaacaagatttggatttgcttcataagcatcgcgaatattacctaagaaacggctacgaatgatacaaccttcacgccataacaacgccgttgcaccatagttaatatcccaaccaaattgttcagaggcttcacgaatcagcataaagccttgtgcgtaagaaataatttttgacgctaataatgctttacgtaccgcttcaatccatacttttttgtcgccttcaactggtgtaatagttttgccgaataattgattagccgcaacacgttgatctttaaaggaagacacgcagcgtgcaaaaacggattcagtgattaaagttaatggaataccaaaatctaacgcattgatacctgtccatttacctgtccctttttgacccgcagtatccaagattttttcgactaaaggttctccacttgcatctttataaccaagaatgtcagtggtgatatcgattaaatagctatcaagttcagtatttttccattctgcgaagatggcttgcatttcttcatagcttaagcctaaaccttcttttaagaattggtatgcttcgcaaattaactgcatatcgccatattcaataccattgtgaaccattttcacaaaatgaccagcaccttcgccgccgacccagtcacaacaaggttcgccttgttctgttttagctgaaattgcttggaagataggtttcacatactgccacgcttcttgattaccgcccggcataattgaaggcccgtgacgcgccccttcttcgccaccagacacacccgaaccgataaagcgaatacctttctccgccaaggctttcactcgacggttcgtatctggatagtttgagttaccgccatcaataatgatgtcgccctcttctaaatgtggtaataatgcttcaatgaattgatccaccacatcaccagcgcgcaccattaacatcactttacgtggtttttctaatttagcagctaaatcttctaaagagtatgcgccgataatattggtgccttttgccgcaccttgtaaaaactcatccacttttgaagtggtacggttatatgccacgactttaaacccgtggtcgttcatatttaaaatgaggttttgccccattacggctaagccgataacaccgatgtcgccttttactgacattgttttctcctgttggattactaaatctttgtttatgatggggctaatataattagcccctacatgttttgtctatgatgtagataaattgtaggagggaattacattcgcccttttaatctacatataattaatcttgttcccataaaataggattattttgaatatattcataaatctgtatactgaatctttgtttatggtgggggctaatataattagcccctacatgtttgtctatgatgtagataaattgtaggagggaattacattcgcccttttaatctacatataattgatcttgttcccataaaataggattattttgaatatattcataaatctgtatactgaatctttgtttatgatgagggctaatataattagcccctacatgtttgtctatgatatagataaattgtaggagggaattacattcgcccttttaatctacatataattgatcttgttcccataaaataggattattttgaatatattcataaatctgcaaataggatttttcatcacgaataatatgttcataataatttcgctgccaaacatcaaaaatttcactattttttcttgcccaagatgttacacctgctttaaatctacgaactattgagccaattgtttgagatgttcccttttgtggcaactgtgttgctctcaattgtaggggcaaattacatttgccctttacctgttcaataatttcaataataccgtgtaaatgatttggcataataacaaattcatcaattcgtacttgtggaaagaacattggaatattttcccaacactgttttacgtaattccctaaatcatttaattgcatttgttgattaatgatatgcccaaatagacattctttatttttacaacaaatggtgatgaaataaaatccttcagaacgataattataatgttttaaacgaatcgatcttcgatgatgaatacctgcattatatttcgtagtcatacattccgctgtaattgtttttatagggcaaatgtaattttcccctacaagcgatcaattttatgcaaccatttgcaaaactattgccaacactgcaggcaacccctactttaccaatatccccttattcttcgtcgtaactgccccaaaaactgcggcgataatcacacaacctaaaaagaaataaatcaccgaaatttggttgatggcataaccaaaaataatccctgctaccaaaaagccgttgtataacccttgattggcgaacaccacttttgctttcaatggtgaacatttctaaatagagaatgtagaaatgttcaagggtgacaagtgcagttaaaatataggctaaaatttccattagagcagccttaccgctgctttgtctaagtaccactccgtcaccccattttttgctttaattttggcagcagggtaaggcagattttctgcaggagtcgtttggatttcttttaaaatatccgctttgctttcacccgttaccaaataggtaatgcgtttggcttgttcaatgagtttggctgttttagaaatgcgaatttgaccactttcaggatgcttagcaatgacagctaggttttcatcatcaaaattagtttgatgtgggaagagagaggcggtatgaccatcaatccccatgcctaaaataatccaatcaaaaacaccgtttggaatgaccgcacttaattcttcttcgaagcgttttagctcaaagtgcggttcattttcgccacgaattcgatggatgttttctgctggaatttgaatatgatcgaataaaagtttttgcacttcgccatagttactttcaggatcagatggcggaaccatacgatcatcaccccaccaaaaatgcagatttttccagttaatttgttccgcataaggtgatttggctagggttttaaataataacttaggcgtcgaaccaccagaaagggaaatatgtacgggaatgatttaattgactataaatcacaaattcttgtgcaattttatcgactgcatgttgagcagttgggaagctgatatagttcattgattttccgtagggtgggctttagcccacaatttattatgttagtaagagcgnggctaaagcccaccctacattagattagttaaacttttttcttcatcaatccacttggtttacgccacactttgccttgttttgcgattaatttatcagctgcaacaggcccccaagtgccagcttcatattcgtgaatacgaccaccattggctttgtaatctaaaatcggttgcacaaatttccatgcggcatgcacagcatcagtacgagcaaacaaggttgcatcgcctttcatcgcatccaacaataaacgttcataagcggttaatacttgcgcacctgctaaatctgcataacggaaatccattgatacttctttcgcctcaaaacctgcacctggttttttcaaaccaaaacgcattgaaatcgcttcatcaggttgaatacgaataattaatttattctctggtgcattttggctgaatacaggatgtggcgtagttttaaaatggatcacaatttcagtcacacgagctggtaagcgtttacccgtacgaacatagaacggcacaccagcccaacgccagttttcaatttcacaacgtaatgcgatgtaggtttcagtacgagaatttgccggtacgcctttttcttctagatagcctttttccattttgccgttaatttcagccgctgtgtattgacccaaaacaaggttattctccatatcctccgaagttaatggacgcaaactatgcatcacttttgctacttcatcacgcattgaattcgcgttaataatcgctggcggctccattgccaccatcgctaacacttgcaataaatggttttggaacatatctcgcattgcgccagaaccatcataatagcccccgcgctcttccacgccaatagattctgcaccagtaatttctacataatcaatgaaattacggttccaaagcggttcaaaccaaccatttgaaaaacgtaatacgagcaagttttgaacggtttctttacctaaataatgatcgatacgataaatttggtgttcttcaaagaaacggtggatttgtacgtctaatgtttgcgctgttttttcatcgtaaccaaaaggtttttcaacgataatacgtttccagccatattcttccgtatttaaaccatgtgcagccaaacactcaggaatcacgccataaagacttggtggagtggacatatagtaaaaggtgttaccacaggtttgatatttatcgtgaagatcgtctaagcgtggaacaagtttgccgtaatcttgagcatccgaagtattcactgcttggtaataaagatgagagcagaaagcatctaaggtttctggtgttgtttcttcattatgaattaacgcctcacgcattttttcgcggaaagtttcatcgttcaagtcagaacgtgcaacaccaagaacggaaaagttttcactcaaacgcccgattttgtagagattataaagggctggaatgagtttacgatgagttaagtcaccagacgcgccaaaaatgacgatacaattattatcagtttgcataattattccttattcggcttccgagtaatgtcgaaaataatgccgtattctagagaaaaaaaccaatcgaaccaatcaattaaattgaaagatagaacgccaatcgaacgattgatcgcccaccataacaaaatgcggattaatcaatgtttcgcgttggttataggttaaaggctcaaaatgagagtcaaaaatggcaccgtgagtttcacctagtagcacttcagcgccagcggtatcccattcgcctgtttgtcctaaacgaacataacaatctaccgcaccttcagccactaaaccgctttttaagctacttgaaccaaccacaacaaattcacaaggaaaatccttcggcaaaatcgaccgcactttttcttgtgaagtggttgcacctaccgcaattcgtaaagggcggtcaaaatttgtcgtgtttttagtgagtttttttacctgatccagttgttttttaaacgtgccgaaatcacacattgcataataagttgtcgataaaattggcgcatgaataacgcttaacacgggtttatttttacgaactaaggttatcaacacagaaaattgatcggtacgattaataaattgttgtgtgccatcaagaggatcaatcaaccaatattctttccaatttttacgttcttcaaaggaaatatgacaattttcttctgaaagaacagggacattagggaaaagtgcggtcaatttttctgtcaaaaattggctcacaaaaagatccgcttccgtcacaggcgtgttgtcttctttcaattcaacatgaacctgtttttgataaaactgttgcaaatgcttacctgattggtaagcaatcagcaatacttggttaagtaaatgttcgttagcgtcagcataaaattattctcttgtttttggcagcaaccacggcattacaaatagagcataaaataccattccgcatgtgcttataacccgagggacaatcccccttcggtcaaccagccccaaaaggaagtgtcttgttcgccgagtaataacaaataaaaataagatgccatattgcagtaaacaaatgaaatgatcgatgaaactaatacaatcgaagcaatgttataacgtgtgtaacggaattttgcggctaaaagtgcggttaaaaatgcgggaatggcggcaagaagaaatgctgtgagagcatagctagaaaaaggaacgataacgccacttgagtcatcatcgaaccaaatcaaaagtgcggtgacgactatctgtaaaatcagagggaaaaaaataagtgtttttaagtaagatttcatagtgaaaaataggctatccagaagataacctattctaaaataaatttaaggattaatcagatttttttcgcacgtaatacgcgagatgcaaaaatcacaatgcccacgataaatacgattaaaccgaaccactcgccaattgtatcccagttttcaagatttaaggataatggcgcttcagaaccaccagtggtaacagaagccgcaataatgaatgctaaaatgacacccattaaactttcgcctacaattaaacctgcagagaaaagcgtaccgaaacgttctgctttagctgacacttctttgttaccaagttttgcaatatggcgagccataatccacgctaggaatgcaccaacaatcacaggcgtattaattgatggtggtaagtaaataccaatccccacagcaataactggcaagctaaagactttgttgctgacttttttcaaaaatgcatcaatcgtaattaacacagcacctaaacccacaccagttaagatgtaagtccattccaatttatttgtgaaaataccttgagaaatggcggtcattaacgttgcttgtggtgcagataaggcttgtgaaggatccatatctggacgtggcaatgcaccactgaaaccatacgcgtgatataagatttctaacactggcgcgataacaagtgcaccgacaaagcagccgataattaatgcaacttgttgtcgccaaggtgttgcttcaactaataaacccgtttttaaatcttgtagattatcattagaaatacaggctgtagtgattacgatagatgccgtaaacaatgtaagtgcggttaaaaatttctgaccatctacagtttcaaataagcccgaggcattaccgattgacaccaatactaatgaaatcacgataacagaaataattccgataccagaaattgggcttgaagatgaacccactaaaccagccatataaccagaagccgctgccacaaagaagccgataaataccgctaagaaagtacaaactaccactaataaaatggaaagctcaggcgaaattggtgccgccgcaataaagtgatgtaatgaaataacaattaacgcaaccgtcgcaattaagatataaatcattgtttttggagaaaggtcaatatcaatacgatgttctgatgcctcttgcccacctttcagcatacggaaagaatgaaccattccttcaatcattggtttcattaaaatcagcaatgtccaaatcgcagcaatgccaattgtacccacaccaatataacgcactttggttttccaaacagtcatcgcagaatcattaaacttgcatccgcggcaatatcttctgacattgtgaaatatggcactgccacaccccaagtcaaaataacaccgatcaacattgcgataccgcccacgataccaattaaataaccagcaccgagtaaggcaagtgaaaagcccattggtaattggaacgccgcttttcctgtttgaatccaagcacttgcaccatcagccatcacgcgtaaaccattagttaaaaatgccactaatcctgctaaaacaccaccgtaagcaatatctttcacaccgctgtcgccatctgcatgattacctgctttcaaaatttctgcagcggctaccccttcaggataaggtaaattactatttaccaccattgcacggcgtaatggaatagtgaataacacgcccaatgtaccaccagctgcacaaatcaacatcgtttgccagaatgggaaatcttgccagtagcccatcattaataaaccaggcaagacgaagatcacagaagaaagcgtacctgctgaagatgcttgagtttgcaccatattattttcaagaatgctagaatctttgaaaaatttgagtactgccatagaaatgacggccgctggaatagatgacgcaaatgtcacccccacttttagaccgagatacacattggatgcagtgaaaattaccgtaatcaatgcaccgaggataattcctcaaacggtcaattcttttaagttttcgttatacataaattgttccttgagcttaaaaaaagaaaaccgcgcaaccttgtcaaaaatttgactatttttcaagtttttttaacataaaatttgttttattgaaaaatgtttaaattaacctgtttttatttttttttcatttaataaaaatcctattaaagaataaaatttttaataacagttcattagcatactttgtggtactattttgtcgaatcaaaataaggagaaaataatggcagaaaaagaagtcagattagataaatggttgtgggctgcccgattttacaaaacacggagcattgctaaagcgatgattgaaagtggtaaagtgcattacaacaatcaacgtgcgaaagtaagtaaaattgtggaagtgggcgcaatgttaaaacttcgccagggaaacgaagaaaaagaaataaaaattatcgccttaagcgatcaacgccgaggtgcgccagaagcacaattactctatcaagaaaccgaaagtagcgtgaaaaaaagagaagaaatcgcatgggcaagaaaaaataattccctttcaatgccccatcctgatcgtcgcccaaataaaaaagagcggagagatttattgaaatttaaacaccaagataaatttgaataaaaatttcaccgcactttctatgttcttaaggtttaatatctcgcaaaattggattttgcattgaaatcaaggtttcagtggattgaatttcatcaattaactgaatcttggtcgccaaaacggaatgtaattctgcaattgtgtgtgtcatcacttttaagaaaatcgaataattgcccgttgtataataggcctcgactacttcatcaaaactttctagctttttgatcactttttcataatcttttgcactttttagaataatgccgataaaacaacatacatcatagcctaatttacgttcatcaataattacttttgtgcctttaataatgcccgattgacgcattttttcgacccgaacgtgaatcgttcctggactaacaccaaaatttttagccatttctgcgtatggtgttctcgcatctttagtgagtacacgtaatattttttgatctaaactatcaatgttgtgcataaaacttcctcctttagattttatttaattttttcacaatgaattagatgatattcaaccaagaaaagaaagtaaataaaatacttgaaataaaatcattatttactgaataatactcaaaaatattactcctcgttaaaaaaggttatcaaaatgaaaaagacatttattttacaacaacaagaaatcagctttgtgaagaacacttttacccaaaatcttattgagcaacttggcattattgaagtgcaaggcccaattttgagccaagtgggtaacggaatgcaagataacttatcaggcattgaaaaagccgtacaggttaatgtgaaatgtattccaaatgccgtatttgaagttgtgcattctcttgcgaaatggaaacgccatacattagctcgtttcaactttaaagaagacgaaggcttgtttgttcatatgaaagcattgcgtcccgatgaagattctcttgatccaacgcactctgtttatgtagatcaatgggactgggaaaaagtgattcctgaaggtcgtcgtaattttgcatacttaaaagaaacggtaaattctatttatcgtgctattcgtttaacagaattagccgtagaagcacgttttgatattccttccattcttccaaaacagattacctttgtgcatagcgaagatttagtaaaacgctatccagatttaagcagtaaagagcgtgaaaacgcaatttgtaaagaatacggtgcagtattcttaatcgggattggcggcaaactttcagatggcaaacctcatgatggtcgtgcacctgactatgatgactggacaacagaatctgaaaatggctacaaaggcttaaatggcgacattttggtatggaacgaccaattaggcaaagcctttgaactttcctcaatgggtatccgcgtagatgaaagtgcattacgcttacaagttggcttaacaggcgatgaagaccatttaaaaatggattggcaccaagatttattaaacgggaaattgccattaactatcggcggtggtatcggtcaatctcgcttagcgatgcttttacttcgtaaaaaacatatcggtgaagtgcaatcaagcgtatggccaaaagaaatgttagaagaattttcaaacattctttaaaatcaattaagtagataacaaaagtgcggtaaaaattaaccgcactttttattagatggaaaacttaaagaatacttaatagctgggcaaaatcatcaaacacccaatctggattggattcacggatagggatattgtaattgtagccgtaagttaaaccaacaactgcacagcccgcagcgtgacctgcgataatatcatttttagaatcgcccacgaaaagcacttggcgtggttcaaaaccaaattttccgcataaataataaagtggagctggatgtggcttaatggcaggtaaggattgaccgcccaacatttcactaaataaatggtcaatgccaaatgcggccaatactggctgaacatgtcttgtgggtttattggtaacaactgctaggacatagcctttttctttcaggatttctaaagtttcttttacatttggatacaagcggctgacattacataaattctcgccataataaaaattaaaacgttctgttacttgcttaacctctgtttcagttagcacttttcctgtttgttttttcgcccaatctaacgctcgagcaattaatacaggtgcaccattgccgatccaagttaaaactaattcttctggcgcttgcggtaaattaaattcagccaaggcagaatttacggataacgctaaatcaggcaggctatttaccaaggtgccatctaaatcaaagccaataagtttaaattgtgtgttcattgtttttctctgttctattacgatcgtgttttattaaaataacagttatgcgctaacacttgctaactgtgtacgtatttggtcaataacttgtttataatctggcttaccaaaaattgcagaacctgccacgaacatatctgcacccgccgcggcaatttctgcgatgttatcaaccttcacgccaccatctacttcaagacgaatgtcataaccactttcatcaatgatcttacgagcctgttgtaatttcttcaatgttgctggaataaaagattgtccgccaaatccaggattcactgacattaataaaaccacatccactttatccaaaacataatctaaatagctcaacggcatcgcaggattaaaaactaatccagatttacaaccacaatcgcgaataagctgcaaagagcggtcaatatgttcgctagattctgggtgaaaagtgatgtagttcgcacccgctttagcaaaatcgggaataatgcgatcgacgggttttaccattaaatgcacatctatcggtgcggtaatgccataatcacgtaaagcctgacataccgcaggcccaaaagtgagattaggtacataatgattatccataacatcaaaatgaataacatccgcgcctgcattaagtacgttttgtacgtcatcgccaagacgtgcaagatcggcagaaagaattgatggggcgataagataaggtttcataaaggttctccgttgagaaaatgagtgcatttagtttactcacttaacgtcaaaaaaccaacagtaatccttatatgaaataacaagataaacaaagaaagggctctttggtgccctttcagtcatgaatataaatagacgaaaatttacacgtccaaatttgctcttaacgcattcagctcaatgaactcacgacgtggctcaacttcatctcccattaaggtagtgaataattgatctgctgcaacagcatctttaatagaaactttcaacatacgacgtgaatttggatccattgtggtttcccaaagttgatctgcattcatttccccaagccctttataacgttgtacttcaagacctttacgagantctttcactaaccattcaacggcttgttcaaaactacgcactggttgtactttttcgccacgaataacataagcaccctcttctaataaaccattgagttgtttattaagagaaacaatttttgcgtattcattgccgtgaacaaaatcaaaattcaagaaataatcggtatcaataccgtgtttgcgaacagtaatcaccgcttcatacacttggcgttccgcattaaattgtgtacgcactgaatattgatgtgcttcagtttcttttgcagtcagttgttcaacaaaagatttaccccaattttccaccgcactttcctctttcatcatttcaatagaaattggcgactgataaattaatccttgcaatacaggggctgggtaatgacggtttaaacgaccgataagtttttgtacgctgttatattctgccaccaatttctcaaatacaagggcattcattgctggtgcatttgtgctgatatgtaattctgcgccatctaacgcaagggttaattcatattgctccatttcatccgcatctttaatgtagcgttcttgttttccttttttcactttgtaaagtggcggctgagcaatgtaaacataaccacgctcaatcagctcaggcatttgacgatagaagaaggttaaaagcaacgtacggatgtgagaaccatccacatcagcatcggtcataataatgatatgatgataacgtaatttatctggattatattcatcacgaccaataccgcagcctaaagcagtaattaatgtgcccacttcttgggaagacaacattttgtcgaaacgtgctttttctacgtttaagattttacctttcaatggcaaaattgcttgagttttacgatcacgaccaacttttgcagaaccacccgcggagtccccctccaccaagtaaagttcagaaagagcaggatctttttcttggcagtctgctagtttacctggtaaacctgcaatatctaatgcccctttacggcgcgtcatttcacgcgctttacgtgctgcttcacgcgcacgcgctgccataataatttgatttacaatgatttttgcatctgcaggattttccaataaatattcctgcattttttcattcatcgcagattccaccgcgcttttaacttctgaagacacgagtttgtctttcgtttgcgatgagaattttggatcaggcactttaacggaaataatcgccaccaaaccttcacgtgcatcatcgcctgaagtcgccactttttcttttttcagcatgccttcgttttccatatagctatttaagctacgggttaaagctccacgaaaaccagctaagtgagtaccgccatcacgttgaggaatgttattggtaaagcagtacacgttttcatttacaccatcattccattgcaaggcgacttctacgccgatgccatctttctcagcggtaaaataaaatggctttggatgaattgggtttttatttttgttcaaatattctacgaatgcttgaataccgccttcataatggaaatgatcttcagatccatcacgtttatcgattaaacgaatagatacgccagaattcaagaaagaaagctcacgtaagcgttttgctaagattttgtaatcaaaggttgtgatagcaaaaatatctgagcttggccagaaacgaaccgttgtccccgttgcctctgtttcgccaatcactgttaatggcgattgaggctcccctaaatgataaaactgctcgtgaacgtgaccttgacgacgaatggttaattgtaacttatcagaaagcgcattcactacagatacgcccacgccgtgtaaaccgcccgatactttataagagttatcgtcaaatttaccgcctgcgtgaagcacagtcataataacttctgctgcagaaacgccttcttcaggatgaatatccacaggaatcccgcccccatcatcttgcaccgatacagaattatcatcgtgaattgtcacgataatatcggaacaatggccagcgagggcttcatcaatggcattatccaccacttcaaataccatatggtgcaaaccagtaccgtcatcggtatcgccgatatacataccaggacgcttacgcaccgcatcaaggccttttaatactttaatgctcgatgcaccatagttatcattggtcgtttctgacataatttatctcattcttttgtaaataaaaattgggcgagattatagcaaaaaatcgccgttttggcgatgcttttcgggaaaggaaaacgataaaaaaagggcgaataatttcgccccataacttgttattttttccaattttttagtgcatcaggcaaaggcattgcctatcacattattacctcttgaattacgcgcctctcgctgcatatttccacgaggtcttgtggataaagtgcggtcagatttgctatcatttttgaccgcactttcatctaatcgcatcgtcaatgcaatgcgtttacgtggcacatccacttctaacactttgacttttacaatgttgcctgtttttaccacttgatggggatcttcccacgaatttatcgcttaatgatgaaatatgcactaaaccatcttgatgaacaccaatatccacaaatgcgccaaaattagttacattagtcactgttccttctaaaatcattccagattttaaatccgttatttcttccacgccctcagcaaatacagcggttttgaactcgccacgcggatcgcgccctggtttttctaactctttgaaaatatcttggacggtcggtaaaccaaattgctcatcaatgaattgttttgcatcaagctgacgtaccacaccggcattactcattaaatcttgaatagattgcgcggtagcttgcaaaattttttcgaccacaggataagcttctgggtgaacacctgaagcatcaagtggatttttcccgtttgcaatacgcataaagcctgcacattgctcaaaggcttttggccctaaacgtggcacttttttcaattcgctacgactttcaaaacgcccattttcatcacgatattccacaatgttttgcgctaaggttttcgtcattccagccacgcgagcgagcaatggtgcggatgccgtattcaaatccacacctactgcgtttacacagtcttccactactgcatcgagtttacgcgcaagttgggtttggtttacatcgtgctgatattgccctacaccaatggctttcggttcgattttcactaattctgccaatggatcttgtaaacgacgtgcaatagagaccgcaccacgtaaagatacatctaaattcgggaattcatttgcggcaaattcagaagctgaataaacggacgcgccacttcgcttactacaacggtttgtggtttattttctttaatttctttaatcacgtctttcgcaaaacgttcagtttcacgagaagccgtaccattaccaatggcaattaattccacgttatgtttgcggattaagctgaaaatcgccacttgagcttcagcttcacgacccgtgtgtggataaatggtggtggtatctaataatttacctgtgttatcaaccatcgcgactttaacacctgtacgtaagcctgggtccaagcccattgtgctcttcgcaccagccggtgcagccattaaaagtgcggtcagatttcgggcgaaaacatctatggcttcttcttccgctttttcacgtaaacttgccattaattccgtttctaaatgcaacgaaactttgattttccacgtccacgcaatcacttgctcacgccatttatctgctggctgtcccgtgaaacgtacatctaaataatcacgaataatttcttcacaataactttgacgacttccctcttccgcatcaggatcagcatttaaacttaattgtaaaatgccctcattacgtccacggaacatagccaatgctcggtgagaaggcacatttttcaataattcttggtggtcgaaataatcttggaattttgcaccttccgtttctttgccttcgatcacttttgatacgataaccgcatttttcgctaaataatcacggactttcgctaataagcccgcatcttcagcaaaacgttccattaaaataatgcgagcaccgtctaacgcagctttgctatcagctacgcctttttcagcatcaacaaaggaaagtgcggttgattctggatcattttttggctcattccaaagtaaattagccaatggctcaagaccggcttcaatggcaatttgccctttggtgcgacgtttaggtttgtacggtaaatataaatcctctaattcggttttgctttgtgtcgcatggattttgtcacgcaattcatcggtcaatttcccttgctcttcaatagatttcaaaatagtttgacgacgatcttctaattcacgcaaataaattaaacgggtttcaaaatgacgaagttgggtgtcatctaagccacctgtagcttctttacgataacgtgcaataaatggaatggtgttgccatcatctaataattgaatagctgcaaagatttgttggggttgaacggttaattctgccgcaataatttggctaatttgttgatttaacattgtcgtacttctttattataaaaaaacgaagatagaatactggttttagcgggatggctcaaatataattcaaaaaactttcttttatttttattatggcaaaatcaaattatattacccgtcaaggctggcttgcgcttgaccaagaactcaagtttttgtggaaagaagaacgcccaaaagtcactcaagccgtttcagatgcagctgcgctaggcgatcgtagcgaaaatgccgaatatatttatggtaaacgtcgtttacgtgaaattgatcgccgcgtgcgttttttaactaaaagattagaagtgctacaaattgtcgattacaacccaaagcaagagggaaaagttttcttcggtgcgtgggtggaattagaaaatgaagaaggcgaaaccaagcaatatcgtatcgtcggttgtgatgaatttgcccctgcgaaaaattggatatccattgattccccagttgctcgagctttaatcggaaaaacattagacgacgaagtgcgggtagaaacgccctcaggttttatcacactttatgtgaataaaatttggtatgaaaaataacttggaagaataaaagataacaaatacctaagcacaaagaaaaactaattgactagatataaaaactatcttacttgcctctttccttattcgctgcaaaatcagcaccttttgcaagcattctcaattgcaaaatcacacgtgctttaagttgctcacgttcagctttactcatatctaaagcattagcccctgcagtgaatacgattgttacgatgccttccgcttgaacataagcaacatattgcgaatattgatgtttgtaggaaatatattctgctaactcatcaacaaaatgcttaatttcgcgtgctgccgcagtacgaaaagcttgagaagtgcctgaactttcgcgtaataacaagcgaaaaacgttcgtgctattagtaataaattcaaaaaatgtatccacagaaacagaaataacactaccgcccgcatcaatgcgtttacgcgcttgacgcattaattggcgcaacatcaaacctgcttcatccaccatttctaagccaagttcatccatatcactaaaatggcgatagaaagaggtaggcgcaataccagcctcgcgcgccacttctcgtaaacttaaattagaaaaacttttttctgcgctaagttgattaaatgctgcatccactaaagcgcgacgagtcttttctttttgaacagcacgaacaccagccattatttcaacccatctagaatagatttaacttcatcgctgaccgcacttgccacacgctcataacgattacgtaatggcgaaccaggacgataaaccaacgcaatggtgcgtgatggctctggcgaataacaaggaatatatttcacacctttgcgcgtaccttcatttagtaccgctaawtcaggcataaaggtgataccagcattggctgccaccatattgcgcaaagtttcaagactagttgcttggaaatgggaattttcttttgcgccagcagtgaagcaataatctagcgcttgattacgcaaacaatgaccatcatcaagcattaacatttcttgaccatttaattggttcattggaagtttactttcttgagcccaaggatgatgctctgatacggcgagtaacattttctcgttgaaaataggtacttcaataaaagcctcagtttctggaacagtggcaacgatagcacaatctaaacgccccgtttccaattgttctaataattgatgcgtttgcgcttcataaagaaacacttctaaatcagggaatgccgcttttaacattggcacaatataagggagcaaataaggaccaaccgttggaattaaaccgatgtgtaatggcccggtcatttctttaccttgattactcgccatttctttcaataattttacttctcgaagaactgtacgagcctgatcaaccaataacatcccagattgagtaaacaacactttacggctagtacgttctaacaaaataataccgagctcatcttctaacttacgaatttgcccacttaatgttggttggctcacattacaagaatcggcagcacggcggaaatgtttatattcagataaagcaacaagatattctagatcacggatattcatgagattttccctatagaaaaattcaattaaaagaatagaattaattgattatgactatatcataattttccctataatacagcacgtaaaatttaaattaacaaccaataggagaaaaaacaatgtctagtatggaaggaaaaaaagtccctcaagtgacattccgcactcgtcagggtgataaatgggttgatgtaactacctcagagttatttgataacaaaacagtgatcgtnttctcattaccgggcgcattcactccaacttgctcatcatcacacttaccacgttacaacgaattagcgccagtattcaaaaaatacggtgtagacgatattcttgttgtatctgtaaatgatactttcgtaatgaacgcatggaaagaagatgaaaaatctgaaaacatctctttcattccagatggtaatggtgaatttaccgaaggcatgggtatgttagttggtaaagaagatttaggcttcggcaaacgttcatggcgttattctatgcttgtgaaaaacggcgtagttgaaaaaatgtttatcgaaccaaacgaaccaggcgatccgttcaaagtatccgatgctgacactatgttgaaataccttgcaccacaacaccaagtgcaagagtctatttcaatcttcacaaaacctggctgtcctttctgtgcaaaagcaaaacaacttttacacgataaaggcttaagctttgaagaaatcatattaggtcacgatgcaacaatcgtgagcgtacgtgcagtttcaggtcgtactactgttccacaagtgtttatcggtggtaaacatattggcggtagcgacgatttagaaaaatactttgcataagcaagtatttagctaattattatttgggaatgtaatttaaagggcgcattaagcgcccttttcatttgtacgaatttattgcaaaaatcaataatggggcggtggcgtttcttcagattgacttgcaatgttagacgattgaaagtcttttaatttatttgccatataacgcaattggacttgcattttatcaatatcaaattgctgttgaactaaagcgtgatttaattcatctaataactgttcctgaaatgcaattttcatttcaagttcttcgatgcgattttctaacatttgttgaatttgcataaattttctctaaattctaaaaaaaagttgagaatagatagaaagccatttaatctattcctcgtattattccattcattataaaggattaacttatatgttaaaaattcaaaaattatctattgcagcattaatggtaagtgcggtgatttctggccaagtttttgcagaagataacacattcgatgaaaaagcggcatcttatgcagtaggtacgctcatgggcagtcaaatgaaagatcttgttgattcccacaaagaagtcattaaatatgataatgcgcgtattttagatggcttaaaagatgctttagaaggcaaagtggatgttcgtaaagatgaaaaaatccaaaaaaccttagaatctattgaagcaaaattagtggctgcatcaaaagcaaaagcagaatcgattgctaaacaagcaaaagaagaaggcgataaattccgtgctgaatttgctaaagggaaagatgtaaaaacgacgcaatctggtttaatgtataaaattgaaagtgcaggtaaaggcgatacaatcaaatcaacggataccgttaaagtacattacacgggtaaattaccaaatggaaaagtatttgatagctctgtcgagcgcggacaacctgtagaattccaacttgatcaagtaattaaaggctggactgaaggtcttcaattagtgaaaaaaggcggaaaaattcaattcgttattgcacctgaattaggctatggcgaacaaggtgctggtgcatctattccaccaaattcaacattaatttttgatgtggaagtattggacgtcaatccgaaatctgaaaaataacggataagtttaatagcgcgcgttctttaacgcgtgctttttattataaaaacgagcggaatttttaccgcacttttaacctaacgctatgacattaaacgataaatatcctttcactgatgaagatcaggctatcataaattcctacaaagcagtcgttgatggtgtcagcgcactgattggcgagcactgcgaaatcgtgcttcattctctcgaaaatattgaacattctgctatttgtattgccaacggacataacactaatcggcaagttggttcgccaatcaccgatcttgccttacgttcgctccgaaatatgcaaagcgaaagtgtttcaaagccttattttacacgagcaaaaggcagcgtactgatgaaatcagttactattgccattcgtaataaaactcaacgtattattggtttgctttgtattaatatcaatttagacgtacctgtatctcaatttttgcaatgctttatgctaacggagcatacgaatgaaacatcttcagtgaactttgcgaattcagtggaagacttggttgcgcagactattgaaaaaacaatagaagaagtcaatgcggatcgtgctgttgccaataatactaaaaaccgacaaatcgtcctttctctttacgaaaaaggtatttttgatattaaagatgcgattaatttagtcgctgaacgtttagatatttcccgacatacggtttacctgtacatccgccaaatcaaacaagagcaagaataatgcgctatgttatcgccgtcaaaagccctatttacggaaagcaaggggcatttttagcttatcaatttgcagaatccttaatcaaaaaagaacacgaaatctcacagatttttttctttcaagatggagtgagtaacggaaatgcattagtgtatccagccaacgatgaagttaatttacaaaaacattggcaaatgttttctattacctacaatgttcctttacatttatgtgttgcagcatctcaaagacgaggtgttgttgataacttaactacaccaactacagctcactacaatcttgcagagggattcacaattgcaggtcttggagaatttatagcagcaagtttaaacgcagatcgagtgataaccctatgaaaatagcctttttatttcgcacatctccacatggcacatccatttcacgagaaggcttagatgcaattcttgccgcgacagctttttgtgaacccaatgatattgggatattttttatcgatgatggcgtattaaatcttatcgataaccaacaacccgaaatcattcaacaaaaagatttcattagaacctttaaattattagatttatatgatgtagaacaacgctttatctgcacagcgtctttgcagaaatttaaattagataatagagaacttatcctatcttgtgaaaaaattgaccgctctttattgctagaaaagcttaatcaagcaggaaaattgtttactttctaaggaatattatgctttatacattttctcaatcagattatcccaaaactgaactagatgattatttttcatatattacagaaaaagatgcggtagtactatggcaagacggtgtgttattggcaataaaatatcctgattattttgccaaatgtaaagggaattgcatgatattaaaacaagatattttagcaagaaatctcaccgcacttttacctcaaagcagcaagataaaattaatatcaatagaagaacttgttggaatcactgaaaattatttaccacagctatcactataaaaatcaaataatttagtaaatactcaagcaaagtatcagatatagaataaaaaaatgcggagaattttctccgcacttttctttttacttcttctgtcttttatctttaagacattcaagaattcatcaattatttgatgattttcgcaacaacgcctgcacctactgtacggccaccttcacggattgcgaaacgtaaaccttgatccatcgcaattgggtggattaagcttactgtcatcttgatgttatcgcctggcattaccatttccacgccttctggtaattcgattgtaccagtcacgtctgttgtacggaaatagaattgtggacggtaacctttgaagaatggagtatgacgaccaccttcatcttttgataatacgtacacttctgattcgaagtcagtgtgtggtgtgattgaacctggtttcgctaatacttgaccacgttcgatttcttcacgtttggtaccacgtaataatgcaccgatgttttcacctgcacgaccttcgtcaagtaatttacggaacatttcaacacccgttacagtagttttcgctgtatctttgataccgacgatttctacttcatcacctgtacggataatacctcgttctacacgacctgttactacagtaccacgacctgagattgagaacacatcttcgattggaagaaggaacggttggtcaatcgcacgttctggttctgggatgtaagtatctaagtggtttgctaactcaaggattttttcttcccattctgctacgccgtttaacgcttgtaatgctgaaccacgtacgattggtgtatcgtcacctgggaagtcatattgagatagaagttcacgaacttccatttcgactaattctaataactcttcgtcatctaccatgtcgcatttgtttaagaatacgatgatgtatggaacacctacttggcgacctaataagatgtgttcacgagtttgtggcataggaccatctgttgctgctactactaaaatagcaccatccatttgtgccgcaccagtaatcatatttttaacatagtcggcgtgtcccggacagtctacgtgtgcgtagtggcgagtcggtgtatcgtattcaacgtgtgaagtgttgatggtaataccacgcgctttttcttctggcgcgttatcaatttggtcaaatgcacgcgctgcaccaccgtagtgttttgctaatacggttgtgattgctgctgttaaagttgttttaccgtggtcaacgtggccgattgtacccacgtttacgtgcggttttgtacgttcaaatttttctttagacattgctaatgtttcctaagaagtgcggtataaaacaatcatattttacaccgctggtttacaaaaattattttttacgcgcttcaattactgcagctgccacacttgttggagcttcagcatattttaacggttccattgagtatgatgcacgaccttgagtttgtgaacgtaagtctgttgcataaccgaacatctcagaaagtggaacttctgcatagattttaacaacaaactcgttcgcttcttgaccgttaaccatagcacgacgacggcttaaatcaccaattacatcaccaacatattcaggtggagtttcaacttcaactttcataattggctcaagtaatactgggtttgcttttgagaatgctgctttaaatgctaaagacgcagcaagtttaaatgctaactcagatgaatccacatcatggtatgaaccgaagtgtaaacgtacaccaagatcaactactgggtaaccagctaatggaccagatttaagttgttcttgaatacctttatcaacggctggaatgtattcaccaggaattacaccacctttgatttcgtttacaaattcataaccagggccttctggatctaatgggtataagtcgataacaacatgaccatattgaccgcgaccaccagattgtttagcgtgtttaccttctacatcattaacacgagtacggatagtttcacggtatgatacttgtggtttaccaatattggcttccactttgaactcacgtttcatacgatcaacaatgatatctaagtgcaactcacccataccagaaataatggtttcaccagattcctcatctgtgtgaacacggaatgaagggtcttcttgtgctaaacgacctaatgctaagcccattttttcttggtcagctttagtttttggttctaccgcaacagagattactggctctgggaattccatacgctcaaggataattggtgcatcaattgcacataatgtatcaccagtagttacatcttttaatccgatagcagctgcgatgtcacctgcacgaacttctttaatttcttcacgtttattagcgtgcatctgtacgatacggccaaaacgttcacgtttttgacgtacagaattcaatactgtatctccagaattaatcactccagaatatacacggaagaatgttaagttacctacgaatgggtcagttgcaattttaaatgctaatgaagagaatggttcttcatcacttgcgtgacgctcaccttcagtttcatctggattgatacctttaatagcaggaatatcagttggtgctggtaggtattcaacaactgcatcaagcattgcttgaacacctttgtttttgaacgcagaaccacaggttaccaaaataatttcatttgctaatacacgctgacgtaatgctgacttaatttcttcttcagttaagtcttcaccacctaagtatttttccattaattcttctgacgcttcagctgccgcttcaacaaggttttgacgccattcttcacagtctgcttgcatattagcaggcacttcttcataagtgaaagtcataccttggtctgcttcattccaattgatcgctttcattttgatcaaatcaactacacctgtgaagttttcttctgcaccaacagggagttgaagaggaatagcattagcacctaagcgagtttttaattgttcaacaacacgtaagaagttagcaccagtacggtccattttatttacaaacgcaatacgcggaacttcatatttattagcttgacgccatacggtttcagattgtggttgaacaccaccaaccgcacagtaaaccattaccgcaccatcaagaacacgcatagaacgttctacttcaacagtaaagtccacgtgtcccggagtatcaataacattgatacgatgttgtgggaattgttgtgacataccagaccagaatgcagttgttgccgcagaggtaatggtgataccacgctcttgttcttgttccatccagtccatcgttgctgcaccatcgtgcacttcaccgattttgtggctaacaccagtatagaataagatacgctcagtagtagtagttttacccgcatcaatatgcgcactgataccgatattacgatatctttcaataggggttgtacgagccattattataaccttgtttatttaatatcagnttatataagggtaasgcttcatcaacgatgaagccctttaaattcaaaaacttattaccaacggtagtgagcaaatgctttgttagcttcagccatgcggtgaacgtcttcacgttttttcactgctgcacctttattatctgaagcatcagataattcgttcgcaaggcgtaaagccattgatttatcaccacgtttacgtgctgcttcaacgatccaacgcatacctaatgcgttacgacgtacagggcgcacttcaactggtacttggtaagtagaaccaccaacgcgacgagatttaacctcaacagttggacgtacattttcaagtgcaacttcaaacgcttctaaaggctctttacctgtgcgttgtgctaaagtttctaaagcaccataaacgattgattcagcaacggattttttaccgtctaccatgattacattaataaattttgcaagtaattctgaaccgaacttcggatctggaagaatcttgcgtgcttcaacactacgacgacgtggcattgcgaatttctccgtattttaatcttcaggatatccaaaacccatcagcaatatttctcattgagaaaatttgcagcgcaaagcgcttttgactggagtttatggtttaaattgttttgctaatttagacgtttggccttacttaacggagaaccattaagctttaggacgtttaacgccgtatttagaacgaccttgtttacgatctttaacgcctgcgcagtctaatgcaccgcgtactgtgtggtaacgcacacccggtaagtctttaacacgaccaccacggattaatacaacactgtgctcttgaaggttatgaccttcaccaccgatataagaagttacttcaaaaccgttagttaagcggatacgacatactttacgtaacgcagagtttggttttttaggagttgtagtatatacacgagtacatacaccacgtttctgcgggcaagcctctaatgcaggaacgttgctttttacaacctttttcacacgcggtttgcgtactagctggttgatagttgccattaaaaaagctccagtttaaatgttattcaagaatagaatgttgttcaaaaaatctacttctatatagaaatagacggcgaattctaatagttttacgctttattgtcaataattaaacaatatgctctaggattaaaactagattaaaatttaccgcacttttgtttttttataaaaaactttattccccacgttttagcattccttgttttttcaaatttaccaaaataattgaaattgctgcaggggtgatacctgaaattcggctcgcttgaccaatggaaaccggacgatgttgttccaatttcgcacgtacttcattagataaaccggaaactttactataatcaaagttagctggaatagccgtattttcatggcgtttttgtttttcgatttcttcttgttgatgctcgatatagccttgatatttaatagcaatttctacttgctcaacagcttccttatcttccattgccggtttatatggcgttaaagaagtcaaaatatcgtaggtcatttcaggacgacgcaataaatcttcaccgctagcctcacgtacaagtggactaccaagcactttattcgcttcttctaaatattccgaacgaggatgcaaccaaatgctgcgtaaacgttggcgttcctgttcaatattttccattttttgattgaaacgtgcccagcgagcctcatcaatcaaacctaattcatgggcaattggtgttaaacgaatgtctgcattgtcttcacgtagtaacaaacggtattctgcacgagaagtaaatacgcgatacggttctttggtaccaagtgtgcaaaggtcatccaccaatacgccagtataagattgatcacggcgtggataccatgcatccttctcttgaacataaagacctgcgttaatcccagccaataaaccttgtgccgctgcttcttcataaccagttgtaccgttaatttgacctgcgaaaaatagaccagaaattgatttagtttctaaggttggttttaagtcacgtggatcaaaataatcgtattcaatagcataacctggtttcacaatacgtgcgttttctaaacctttcatagaattcacaatgcccatttgcacgtcaaacggtaaactggtagagatcccgtttggatacacttcattactggttaagccttctggttctaaataaatttgatgtgaattacgatccgcgaaacgcatcactttatcttcaatggatgggcaataacgtggaccaatcccttcaatcacaccggtatacattggactgcgatccaagttattacggatcacttcatgggtttgttcattggtatgggttatataacaaggaatttgttgagggtgatcatcaacagatcccataaaagagaacacgggcaacacctcatcaccatgttgtttagctaaaatatcaaaattgatcgtacgcgcatcaatacgcggcggtgtacctgttttaaggcgatctacacgtaatccgagatctcttaatcgatgtgaaagatttacagaagcagaatctcctgcacggccaccttcataattttccaaaccaatatgaattttaccagctaagaaagtaccggccgttaagatcactgattttgcacggaaggttaatcccatttttgtgctaacgcctgtaactcgatcttgctcaatcagaatatctgtcgcttcttgttggaaaatatctaaattaggttgattttctaatgcagtacgaacagcttgacgatatagaactctgtcagattgagctcgagtagcacgcactgctgggcctttactgctatttaaagtacgaaattggatccctgctttatctgcagcatgcgccattaaaccgcccattgcatctacttcttttactaaatgacctttaccgatcccaccaattgcagggttacaagacatttgccctaaagtatctacattatgtgttaataaaagggttttaaatcccatacgagctggtgcaagtgcggcttctgtacccgcatgaccaccaccgatcacaatcacatcataagtttcagtgtaaaacatatctatctctatttattctgatcaaaaaattggcgttattctacagaaatttaaaacacctgacaaaaaaagaatggatctattgatcctttgaaagatcaggtttgtattagtaaataagatctctttttatatataaagatcttattattgttattattaagatcttttttggttgtgagtaaccttattcgatccttatggaaacaggtgttataggatccaaaaatcttgtgaaaatgcgatcattttctttaaaaatcttgtgtgtaaaatggaaagttattaacaactttattttttctcaacgttactaagtgagtaaaaacagttttatgacagattatttatgagttatccacagataaaaatgaatttttattgaaatccctataatttagttttttaaacaattaattttattaaatgtacgttttatgatttgactttgtagttactacaggttttatgcttccttcaaatcaaatagttaaggaaataaaatcaaagattttttacagtctattgttaccgaaagtgaacataatgaagaggaatgtaaagcaatagaaggattgaaaagcgaatgcaatttgtaaaaatactcaaaaatttgaccgctctttaggaagaaaaaatgccgcctaaattttaatttttagacggcattttattttcctaattattatttagataaatcaatttgatacactgcaaaacctatttcatctgtacccacttgtttcattgggtattgtgctttttctgcgataaatttcgctgcttgttcgcttggcgatgtttcaaaacggacatctaatttatcgttacctgtgataggcacaaaacgccagtttttatccgcatttggattaactgatccttctttctcactggttgctttaatataatcagccaaaatttgacggctttcatcaggcgaggcataaacaatatgtttatcaccagtacctgggaatttattgccgtaagcacgatagttattcgttgcaatcaaaaattctgcttttggatcaactggtttgccttgataagtgagattcactacacgatgcgattctgggttaattaatttacattcgccatcgtaacgagctggtttggttagatcgtattcataattgacaccatcaatcacatcaaagttataagtgcggaaaccttcccagtcgattaatgattgtggtttatcacttgtagggtcaatttgtttaaacataccagcactacattctaaccattcttttaattgttcgcctgtcgctttaacaaccactagcgtatttggatagagatataagtctgcagcgttacggaaagttaatttacctttattcacttcggtataacccgttgggtcatttttacgaccgcctgctttaaatggtgcacctgcacttaaaataggtaagccagccattgctgcaatacttggtgcaactttctctacatacgctttttgtgcttggtttacaatttgaatggttggatcatcttgtaataatgcaaggtaactatacatattgtctgtggctttgccgataggttgagaaacatatttacgtgtcgcttcgtgaactggttttaaaagtgcggtaatttctgggtcattttttgcaagtgcttttttggtttctatatcataaattggacgaagtacagctttgccagaagtcacgatccatttacccttgtgttctgttaagcctaaatccaccacgctgatattatttgcccagtaaccagccatactttctggtatgccttttacggtaccatttacgatgtccgcatttggtgatttcgcaaattctttatttgggaataaacggtgtgagtgaccaaaaataaccgcatcaatatgtggaacatccgctaaatagaatgcagagttttcagcaccttcttgataaggttcatcagatgggcctgtgtgagctaatgcaacgacaatatcagccccttttttcttcatttcaggtacatatttttgtgctgtttttacaatatcacgggtttccactttgccttgaaggtttgctttatcccaaaccataatttgcggtggcacaaaaccgatgtaaccaatttttaatttatgtgttttaccttgattatcaacaactgatttttcttgaatgacataaggtgtgaaataaggttcttctgtccccgcttttactacgtttgaattcacaattgggaatttagcttgtttgatggcatctgcaagataattgagaccatagttaaattcgtggttacctaatgtacccacttcataattcatcgcatttaaacaatcgatcgcagggttagatttaccctctttatagccttgtgcggcttgatagtctgcaattggattaccttgaattaaatccccattatctaccaatacgctattttttacttcagcacgtgcttgacgaataaggcttgccgcacgagtaaaaccgaatttatcggttggtgcatctttataatagtcaaaatcggtcaagaaactatgaacatctgttgttgccacaatgcgtaaatcaacatcgctctttccttttgccatcgcaaaacggtttgcacttaatgcaagaatactggtcgcactaatttgaataaaatgacgtctgttcatcatagagttttccttattagggtgagtaaatattccctttattctaagaaaaatagcggattcttaaaagaaaggagtaaaaatatttttatttaattaagataataatttctgtactaaggaagtataaatattaaccccagtaagtaattgattttcatcaaaatcaaattcagcttcgtgatgacctgctgtgcgatctgcgccaagaatgaagtaaattgctttgcctccatgttcttgtacacgtctacctaagatagtcgcatcttcacttgcattgaaagcataatctgaatttacgttatttatttgtggttgttcaagggatatttcttcgatgagttttataagttcaacatcgttattcatatccacggcttcacctacaatttcagtttcatatgcgacattaaaacttatggagatacctttggctatttgcatgacttgttcagtcatgtattcattaattgctttattttctccccgcacttctaattgtaattcagcagaggatggaatgacatttcgtccttcacccgcttttagcacacccacattaattcttgtcatgcctttaccatggcgtgcaataccatgaagttgagtgactgtatgcgctgcagctaataaagcattacgacctaaatggggcgcagcacctgcgtgcgcaggtttacctttatagcgaatatcaatttttgtagtggaaagaaaatttcttggattagcaataactgtgcctgtattcgcgcaaaaactaatgtgtgaagaagcaaaataatctgcatcatcaattatgccactttgtgcaatggctgctgcacctcgaacaccttcttctgctggttggaatacaatttttacttttccagtgagtttatctttgttctgagcgatccataatgcaacacctaaacctattgtaatatgtgaatcatgtccacaagcatgcataaaaccatcgttaattgaggcaaaaccttctttatttggaatatgctctggtgagcgagtttccgttacattcacacagtcgatatcaaaacgtaacgcgatggtttttcctggtttacctgaatcaaataatgccacacaaccagtgtatccttccattttttctagccatttttcattggctccataggcttttgcattagctaaacctttatctactacggcttgttttcgtccacgaacaaagtctggatttataatttgtttgccaagaaaaatttcaaaacaatctaagtcttccaagtaatccgcaatgcgagaagttgtccaaaattcactccagccaatttctggaaaacgatgaaattcacgatgccatttaacaagttgatttaaatctaagttcatttttttcttcctttaaaaggctataaaaacagaccgcacttaaataaagtgcggtcaattttttactatttttacaacataaataatgctaagaataaaacagcaagtatcatgcctggcgcggtacgttttaccatttctactgggcttaccatcgcaaggcctgcacaaacaatggttacacctgcaattggtgaagctgtacgaccaattgcaccagcaatggctgctgccataccaagatttacatgagtgtaaccgagttctacagcatgtggtgtgacggcagtnttaaaggcaatcgctgctgcatcgccagaacctgtaattaagcccattaagaatggtccaattgttgcaccccaacgtacaaattcgttggattcttttaagaaagaaattgcagcatccactgcacctgtagattttaatcctgccacaaatacactggctgcaatgataataccaagtacgtttgcataagaatttcccataccattgaaaaattcttctgtgatttttactggggaaatacgagtgacgataatgccgtaaattgcaccaattagcatcgcttgaggcacacccattttagtccattcaagacctggcacttgttgtaatgatgttccaccaatcactaaaataactaatggtattaatggtgcaagggcataaagtacattgacgccttcaataactttaatttcactttctttttgttctgcaagataagcttggcgatgttgttcaccataatctttaaaaacaagcgcaagaattgttaaaacaaccgcacctattgctcccgcaatcatgttatatggtgcatgtgaaaggtttacttgagtgatagttaagcctgacatttcactaatcattgctgagtgagaagaacctgggctcatcattgatccaaaagttcctgctaaaatagctgcccagcagtagctggtcgaacacccgcactttttaaaacgggaattaatgttgcgccaaccgcagcagcacaaccagcagcagaaggaatagcaatattgatgaaaaaggtgatgatggttgcaatcggaattaagnagaattttaatccgcttaatggtttggtaagtaaatgcactagatgagtatcacattgagtgtatttcattacataagcaaaacccatactggaacagatagccataattaatccgccagatgtcatacttttggcaaaagcatctaatgcacccattggattcagcgttagaatggacataattaagcctacaccaatcaaaacagttcgggtttcggcttttttaatcagaaaataaattgtggcaataatgccaatcactgcaacgatggatttaaataattccattatatgttccctttaagttaataagaaaaagttgtattgatatcaaatgtgccacattccatattttcactgaagcacaaaataggattttcgcccaatacggttgcccattccattttgtatatgaagcgcagaaccttcaggtaatgcatatacaagtgcggttggattaacgagtaaaaattctgccaaacgttcttctcggctttcaccattgtggccttgcattttacctgaaataaagtgcggattaatttgatgaggaaaaagctgtaatgcttgaaatgaaggaggataagtaatcggcatatcattagttgtcataatagatgagccagctacattggccccagcactccaaccaaaataaggcgtaccgttatttactttttcacgaatgatatcaatcaaattgtgttcataaagctgttttaacaaacaaaatgtattcccgccgccaatagcgatgacatctgcttgttcaataatatctcgatgctgtttgccacgatgaacggaaacaatattcatccctaaatcagaaagtgcattttgcacagttttttcatattcatcaaaagtgcggctcaccccagcataaggtacaaaagcaattgttttaccacgataatcagccaagaaattttgtaaccaaggtatggtgtgttcaagataacctgtgttcttgtattttgagctactgagcagtaacatatttttcatatttataatcctttttaggggcatttagcaataccaatattacgcttagaaaaggttaattttcaacgaaaaattataattgtttgacgaatatcaaaaaataaaccgtatcaggagaaaactatgtcaattaatcttaatcgtgttcaaaatttaattgaaaaactggcttttatttcatcagtaccaaacgagctgactcgcttagcttttacagaggaggatgaaaaggcccataatatgattattgaattatgtaaagaatatgatttgtctattcgtcgagattcaattggaaatctttttattcgtaaggcaggtaaagaagattttttacctgcagttgcattcggatcacatattgatactgttgtgaatgctggtaaatttgatggtcctttgggatctgttgctgggttggaaattcttttgcaattgtgtgaacagaatattcagactcgttatcctttagaattgataatttttacttgtgaagaatcgagtagatttaattttgctacattgggtagtaaagttatgtgtggcatagtaaatcaagaaaaattaagttcattacgtgataaacaaggaaagggtttatcagaagctatggctgaagtaggaatgaattttaatttggttaatcaagcaaaacgtgatgcaaaggaatttaaatgtttttttgaacttcatatagaacaaggccctcgtttagagaatgaaggaaaaacaataggtgttgtgacaggtattgctgccccgattcgtgcaattgttaaaattaaaggacaagcggatcattcaggagcaacagcaatgcattatcgtcatgatgcattgttaggaggatctgagttatcacttgctattgagcgagctgctattcaagctggacattctacagtagctacagtaggtaatattacagctaaaccaggagtaatgaatgttgtgccaggatattgcgaattattagtagatattcgaggtacacatgtacaagctagagattctgtatttgaattattacaagaggaaattagtaaagtttcagaaaaaagaggattattaattgagttacaacttatttcaaaagataatccaataatattacctgaaaatatggtaaaccaaatagctgaaacagcacattcccttggttattcttacgaaataatgccaagtggtgcaggacatgatgcaatgcatatggcaacactttgcccaacaggtatgatttttattccatctcatttgggaattagtcataaccctcttgaatttactgattggaaagatatagaggcaggaattaaagttttacaaaaagttatattggagcaggctgaagtttgttaattgttataaaaactcgtataaataatacgagttttttataaaggcaattccgttgtcgattttactgtttttaatatgatttctgattttaatgttttgatgccgattgcatttgtaaggtgggtattttttatatgattaagctcttcaatatcagagacacagagcttaagtaagaagtcgtaactgccagccataaatcgatagtgccgttgtgatgagctatgatgcagaaacgggcattgctaaagtaaaatgtcaatcacaaagcacctgtggggcttgttcggctagagaaacctgtggaacagagtctctttctgaacttaacggaaagcgaggcgagcatatcttcacgctcgaaaccattacgccactgcgcacagaccaaatggtagaaatcggtctagaagaaaaatccatgcttttctccgcattgttaatgtatatagtgcagcttttcacgctattagttgcaacattgctttctagctatatcagtgaaaatgaactcatccgtgcgattttaatctttatgttgaccgcactttcctttgtgatggttaagcgttacacccgaaaactcggccaacaaacagaatttcagtctgttttgttaagagtattgttctaaataaaaagagcggttgaaaacaattaaattttcaaccgctcttttgtacttagcttattactactcgaaagagcctacattaagatgtaggcgtttcttttttattttttaagatcaaatttgtaagaaacaaagccatacaatgtccaaccaataaaggtcacaattgaaccatataacatcgcttgttcaccggctgcataaagtgcatagatactatagagtgaaccaataaaggcaacaaaaacggttgttttatatttttgtggcgcaacattttccgctttcaataacactgcgagagcagccattgagagcaaatatgggatgacgtttgtaaccactgctaagtccaccaacacattgaattgtttatttaatgatgggctgattgtcattaaagagagtaaagtctgtaacgcagtaatggtaatcataccaacaacaggtgcatctttactggtaatttttttgaaaaatgctgggaaataaccttcttctgctgaagatttgaatacttgagcaatagtgaactgccagcctaataatgaaccaaagcaagacattaccattaagcccatgataactttaccgacagtttcatcaaacatatgagcaaaggctaaaccgaatggcgctgttgaatttgcgagttcaaggttaggtacaatacctgcaatcacgttagttgaaacgatataaattaccgcagctcctaaggtaccaccaagtactgcgattggtacgtttttctctggattttcaacggcatctgcgttagcacaagctgattctaaccctaagaacgcccataatgtcattgaaatagatacaccgatcgcttcaaaagttggtacattgtgcgggttccaagagtttacatacattgaaccatcaaaccatttccaaccaatgatagaaatacctaccacaggaataattacgccccaaatggtaaatgaactgatattaccggtgattcttgcaccaccaaagttaagaacggttgcaagccaaagggtgaagatagtccataatgcgatagaaagtggtgaaaggattgtgccgaaaagctctgaaccataacccaccgcagaaattgcgattgctgtattggcaataactaatgatacaccgtaagtgtagtttgccatgaagttaccggctttaccgaaagagtattccgcataaccgcccataccaccagattttttgctaaacattccacattgggcaaatgcatatgctaatgcagttgagccaaccgctgtgaccagccaagacactattgaaatggttccaatttcggctaatttggtcggtaacataatgataccagaacccatcatattaaccatggtaagaatggtgagttgtaccacaccaattttattgcttttagcactcataatttatactcctacaagtgcggtcaaaaaatcagatatttttaaccgcacttttttgtttgtgttgagagagttatgaagaagatcctcacaacctcactttattaatagtcagttaaaacatagccatatgcacgagtacgtccatcagggtctttttgtaagtaaaccccttggatttcaggtgcgaaaccaggtaatgtgttgatcccttcttctaacgcaaggaaatattggtgtgctgtagtgctccatttttctcctggcactacacataacacacctggagggtaaggtaacgcaccttccgcagccacacgaccaacaatatcagtcaacggaacgagttcaactttgttacgtattaactcaatatttgcatcatgtggatttaatacatattctggtaatgtcgctttgcggaacaaatctttttgaagttgttttacatttcggcttacataaagatcatgcatttcttggcataattgacgaatggtgtaacctttgtaacgatcttcattgtttttatacacagttggtaagacatattttaataaagagtcttgtttaatgtgtttttcaaacaaggcgatttgagcaactaaagtttgcattttggtgatggtttctgctggagtgagcaagaataagattgagttcaagtcacatttttccggaataataccgttttcacgtaagtagttagcaagaatggttgctggtacaccaaattcttcatattcacctgtttctaagctaatacccggtgtggtaagcaagaatttacatggatcaacgaagtattgttcatcagcataaccttcaaatttatgccatgtatctgttgggtggaatttgaagaactcgagattagttgcgatttcctctgtgtcataatcttgccattttttacctttaattgtggttggaataaatggacgaattaattcacagtggtttaacactaatttacgcgcttcgatacctactttcacacattcatgccataatcgacgaccagcttcactaccttgaattttcgcattcacatctaacgtagcaaataacggatagaacggactagttgacgcatgtaacataaaggcattattgaaacgtttgtgatttacataacgatcttgacctttaatgtgtttatcttttttgtgaatttgtgaagtttgtgagaaacctgcttgttgtttatgaacagattgtgtcactaaaatacctgggtcattttcatttaattcaagcaataatggcgagcagtctttcatcattggaatgaattgttcataacctacccatgcagagtcgaataagatgtaatcacaaaggtgacctattttatccactacttggcgtgcgttataaattgtaccgtcataagtacctaattgaatcactgccaaacggaatggacgtttttggtttaatttttcaggtgcaacttctttaattaatgatttcagataatcttcttcgaagcagtgactatcaataccaccaatgaaaccaaatgggttacgtgcagtttctaagtaaattggggtagcacccgcttgaattaatgcaccatggtggtttgatttatggttattacgatcaaataacactaaatcgccaggagcaagtacagcatttaacgcaactttgtttgaagaagatgtaccattcaatacgaagtaagttttatctgcattgaatacttgagccgcatatttttgtgcatcacaagctgccccttcgtgaattaacaagtcacctaatttcacgtccgcattacaaatgtccgaacggaaaatgttttcaccgtagaagtcataaaggaaacgaccagctggatgtttacgatagtattgaccaccttgatgtcccggacagtcgaaagcgatattacccatttccacatattcacttaacattttgaagaatggcggtaacattttttcttcataaagttttgctgcagtttcgatttggcggctataaagtttgatgtcataaccgtttaaatcttggatatggtaaatagaatcatagaattttggatccacctgttgttcgtcggtttgaacaataaacactggaacatcaaatttcgttgctttaattctatcgaggtattcacctacatcacttgaacttaatacgatagctgcaacatctgtaaagtctgttttagcaatctcaactaattctctatttgtagagaaatattgttcaacttttggactatatgcaatttttaaatttggcataataaactcctttatttatttttgacgtaaagttacccagcattattaattttaataacgcaatagatttatttagaataaaataacacgatctagttttttattataaaaactaaagtaagaatatatttattttaaattaaataagatcaagttaatttcataaaacatttcttacctgttctaggcaatacaaaaatatccagaaattaatctatggagactctctaaacagagagaacaactctgtttagagagccctgttggatggtttgttttgagaagcaaataaagagtatgagaaacaagaacgataggatggcatcataatatgacgagtgcgacgaatatgagccattaaagaacgacctttaataggattaaaccgnaaaaatcttaatgcctttgtatggacatatctgtgtatatatgtacgaaatagcataggaaaaatccctctttctatctaaagtaacctctcttgggtatattctcaagcacatttaaggatcatgtcaataatattttttaaaaaatgtgatcttagtcaaaaacaattttaaattttacataaaaaatacaaaaccaaaacaaaaaaataataaagttattaaatttttagaattagaaataaagctattttatataaatcttaaaccaaacttgctaccattaccgctttaattgtgtgcatacggttttctgcttgttcaaatgcaatgttcattggagattcaaatacatcttcagtagttgttaggtgggcttcagcccaccaacaaacaatcgcgagatattttgtggctgaaggcccnccctacgttaagtacgcatcattctatgcgtgcttctttttattttaggcgcaatcattatgatgattttataaaggcaattcagttgttgatttgaccgtttttagagtaacttctgattttaaggttttaatgccaagcctagaattaagataggtatttttgactaattaaacgctatataaggatacttgtactactaataaaatggaaccaattagcaataagcatccaatcattggcatgacgaatttaacccatctatcaaatggaatttgcaacatttggagtgtcactaacactaatcctgtcggcgccaagaatagcattgcatattgtccccagttgtaagcggaaaccacgatatcgcgtggaatacccactgagtcagcaagtggtgccataattggcattgaaagtacggctaaaccagaagaagatggtacgattaaacctaggaaaataaatacgactaattggcctaagatgaatacgctacccggcataccactaactacattagacatataatcaaggatagtgtcagaaatcataccttgttcgagtactaagtttacgccacgagcaagaccaatgattaaggatacgcctactaattctgatgcaccttcagtgaaagattccataatatctttttcagacaatccactaataaacataatgatgatggtaatggcaaggaaagatgcagccatttgagggaaccaccatccgccaaccattacaccccaaatcataatagggaatgagatacagaaaagcgttaagattaatttgcgacgagctgagaatgggatagttgtgttcggatcaaagtttttcatataacgttgacggaattcttcgcgatcgtcgtaagtataagaaaaacttgggtcagctttgatttttttacagtaccaataaagatatgcgattacgcaagttgcccctaaaactaaacctagagcacggaaaccaataccttcagtaaattgaataccagccgcatttgatgcgataacaacggagaatgggttaattgtagagaatgcagttcccatagatgcagcaaggaatatagcccctacgcagactatcgcatcatatcccagagccaagaatacaggcaccagaatcgggtagaatgccactgcttcttcttcgataccacaggttgtgccgcctaacaccattaagacggatacgcagaatacaataaaaaactcattgcctttagttttcttcacgagagccatcaaacctgcattaaaagaaccggttcggttaataacaccaatcataccccccaatacgaagataaagaccataacatcaacggcttcgatagttccttccaccatacttttggtgatgtcttcaatgcctttgtggtgttgttctacacgttgataggtgccaggaatagcgattggttttttgatcacgccttcggtgaagttggagagtttaattttgatattgagattatcaagagtgtctgttgtggcgggataagttttatcatcaacgccgtaagctttgacaacaaatacattatcagtggaattatatgttaattttgaatatgaaccggatggaataacccaggttaatccaacagcgagaattaatattgcaaataaaatggtaaacgctgatgggaaattaaacgttttcttctttttggatgcatccatagcgagctccttatgtttaacgtttaaagtgcggttggtaaaacattggttaaaccaaccgcactttttaccttgagaatggcttcccaaagttcctttattatttaagcataataggatatgccttcagtttttttcgtaatacgagtaccagctttgcctttcacaatgtccacaatatcagataaagatcctattactgcatcttttcctgtttgtttcgcaaagttgatcgcggcttgtactttcggccccatggaacctgaagcgaaaccaagttctgaaatagcttcaggtgaggcaactgaaattgctttttgattaggtttaccccaatctacgaaagttgcggaaacatcagttgcgatgatgaataaatcagcgtcaagattttctgcaagtaaagctgaacataaatctttgtcgataacggcttcaacaccttgtaaattatggtgttcatcataataggttggaatgccaccgccccccgcacaaattacgatactgcctttttcaagcaaccatttgaccggacgaatttcaaaaatacgttttggtaatgggcttggcacaacgcgacgatatttatcaccatcttgtgctatagaccaatttttttcttttgccaaacgttcagcttcttctttcgtataaacagggcctattggcttagttggatttttgaaagctgggtcgttgatatcaacttctacttgagataataacgttgcaaatggcacttcaaatggaactaaattaccgagttcttgttgaatcatataaccaatcattccagctgtttctgctcccaatacatctaaaggataggttggcacatcagtataggcagcaccttgtaaggcgagcaaacccacttgtgggccattaccgtgtgctatcactaattcattatttggccaaatcttagcaatttgctcacaagcaatgcgaacattttgtcgttgattttcggctgtcattggttctccgcgtcgtaataacgcattaccgcctaatgcaatcactattctcatacgttctccttatgccaaacttgctaccattaccgctttaattgtgtgcatacggttttctgcttgttcaaatgcaatgttcattggcgattcaaatacctcttcagttacttcaataccattagctaattcaggatatttttcagcaatttgacgaccaactttggtttcgctgttatggaaggctggcaagcagtgcataaatttcacttttggattaccagtgcgtttcattaattcaggtgtgacttgataaggaagtaataatttaatgcgttcgccccaagtttctaatggttcacccattgaaacccacacatcagtatggataaaatctacgcctttcaccgctttgtcgatatcttcagttacagtaatacgagctccactttctttcgcaaatttttcgcacatttccacaagatttgcttctggtaataatgctttaggtccacaaatacgaacatccatacctaattttgcaccaattaataaaagtgaattacccatgttattgcgagcatccccaatatatacatagctaatttcacttaatggtttgtcgcaatgttcaatcatggtaagtacgtcggcaagcatttgtgttgggtggaattcatcggttaaaccattgaatactggcactccagcataatcagccagttcttgaacgatactttgtttaaagccacgatattcaatgccatcatacattctgcctaatacgcgggcggtatctttcatgctttctttgtggccaatttgagaggaattagggtcgatgtaggtgacttgtgcgccttgatcataagcggcgacttcaaatgcacagcgtgtacgggtggaggttttttcaaagatgagcgcgatatttttgccttttaatttttgttgttctgtgccagcatatttggctcgtttcaaatctcgggagagatctaagagatatttaatttcacgttctgtgtgatgaacaagactaagtaaatgtctatttttcatattgaaagccataataatctccttgtgttttgactatacattggggaataaacatacatcattcgagatactgcttgttgttcgaacagttgcattataagagaggtaaaatgaaatttgttgtcgtttttcaactggtaatgccagtatgtagaattttattgcgagatttttagtattattagaatttaataaaataatctaactctttattgttatttgtttgatttctaatagtagatgaatttaaacgaaaatatgttttagtttatttttgatgaagaggaatgtgtctatctatacttaataaaagtgcggttatttttattgcagtttttaatatattgatcttcagcaagtaccatttgtatatttagtgatatgataaacatagtttattttttgaggtttttatgaatttaccttttcgagcaatggtgtctgatttagatggcacacttttaacacctgaacatttagtcggtgatcttaccattgatacgctgagagcattagagcaaaaaggcgtagatattattttggcaacaggacgcaatcataccgatgtgtcatccattcttggaaaaattggtgcggaacgtgcggttatgattacatcaaacggtgctcgtgtacgggatttacagggtaatttgctttatagcaatagtttgcctgaagaattagttcttgagctttacaaaacgccatttgatacttccaaagtatgcatgaatagctatcaagatgaaggttggtttactaataaagatattcctgcaatgcgtcagttccataaagaatctggattcgattataacgttgtcgatttttctaaacatcatggacgtgggacagaaaaagtcttttttattggtaaaacgccagaggatttagttgaagtagaaacttatttacgagataagtttggtgacgtaacgacaattgtttattcagcattagcttgtttggaagtaatgaataagaatgtttcaaaaggggatgcattaaaacatttactcgaatcacgcgagtatgagttaaaagactgtattgcttttggtgatggaatgaatgatgtagaaatgctttcttgggctggaaaaggttgcattatgaaagatgctgatattcgtttaaaaatggcttgtccagagttagaagttattggctcaaataaagaagaatcagtcgctcgttatttgcgaacccaatttggattagattattaatgcaggcattattattcataagttatggtgcaatattaggcgcgtcattgcgttgggctataggattgttatttaatcctttattttcctcatttgcttttgggactttaatcgctaatttgtttggctgtttaattattggtgtattacttgggcttttttggcaatttccacaaattagtgctgaatggcggttatttttaattacgggttttttaggatcgctaaccacattttcgtctttttcttccgaagttgtggaattattttttaatgacaagtggttaaatggattttgtgtattaatgatgcatttattcggatgtttagctatgactgtgttaggcatttggatatataaaatttgtctcaacttttatcttaatcccattcactttggttttgcccaattaaatcagcaaattcatcgctacgaaatccgtgtgatagcatatattgccaaattttttgtttcattttaggcgtttgctgttcgttataatttgggaattttttacgtaacaagttctcagccatttcataccaatcaatttctgattccattaaaacttcatcaataatatcagaagacacaccttttaattggcgtaattcttgtcgaattcttcctacaccataacctttttgcacgcgtgaatttagataattttctgaaaaacgacgatcactttgccaattttttgcttggcatcgagataatgcatcatcaatttcttcttccgaaaagttcttttcctgcattttattgcggagctcgaattcactatattctctgcgggaaagaagattaactatgtaattaaaagcaagagatgacaaggaatgattcctttatttttattgagttgatataaagtgcggtcatttttaaccgcacttttggcatttgtaattttctttattcaaaatcactttctgattcagtattattttcagattgttcaatatccgccattaaggcttgttctggattggccactaattcagcacgtaaacgagcttctaattcatctgatttctctatattttcgttaagccatttcattgaattagcctttccttgaccaattttttcaccattgtaggaataccaagcgcctgatttttctacaagtttgtgttttacaccaagttctaataattcacctgcttttgaaatgccttctccatagagaatttggaaatccacttggcggaacggtgccgctaatttgtttttcactacttttacgcgggtttcatttccaataatattttccccgtcttttacagaacctgtacggcgaatatctaagcgaacagaagaatagaattttaatgcattaccgcctgtggtggtttcaggattaccaaacatcacgcctattttcatacggatttggttaataaacacaactagacagtttgcatttttaatttgacctgtgagtttacgcaaagcttgagacattaaacgtgcttgcagccccatatgagaatcgcccatatcgccttcaatttcagcttttggtgtcagtgcggcaacggagtccacaataattacatcaattgcacctgagcgaactaatgcatcacagatttcaagtgcctgttccccattatctggttgagaaacaaaaagttcttttacatctacaccaagttttgctgcataaataggatcaagtgcgtgttctgcatcaataaatgcacaggtttttcctgctttttgcgcttgagcaatgacggaaagagttaatgttgttttacccgatgattcaggcccgaaaatttctacaattcgacccataggcaaaccaccaatccctagcgcaacatctaacccaagtgaaccagtagaaatagactctacatccaacgttttggtatcgcctaatttcataattgagcctttaccaaattgtttttcgatttgccctagtgcagccgctagggctttttgtttttcttcttgagttgccataattaaaatcctgtttgaatgttcaaatttttgtgattatatctgtattgatgtacaggtcaagaaaaatatttatattaataaaaaaatatggggtatatatttcagtaaagaggatggggaaggcttaaaataaaagntttaaatatagtatattaatatataaaccaatcgtttagataaaaataaattttaaatttacgatctggctcacaaatctgacatttatatttaggtgtagtaaaaatttcatgatataaatgaaatcagaagtacttctactgactcttttaaaataattattcattggaggtttaatatgaatataaaggatgagcatatagatagcgtttgctccttgttagatcagttagtaggaaatgtttcctttaaaaatctttttactggttacggtttgtttcacaaggaagagacaatgtttgctatttggcaaaataaaaaactttatttacgcggtgagggtgttctcgcaattcaattaactaaattaggttgtgaaccttttacaacgaatgaattgaataaacggtttgtgctttcacaatattatgcactttctgatcagattttacgtagtaatagattgtgtagaaaattgattattctttctattaagcagattcttgagcagaagctagaatgtacgttaagaaaattgaatcgattaaaggatttacccaatttaacgattaaacatgaaagagctttaataaaagttggtattacaaatgttgcgatgctaagagagattggcgcagaaaatgcattggtggaattaaagaaaagtggcagtggtgctacgcttgatttttattggaaattagtatgtgctttgcaaaataaaaatagtcagatgttaagtcaagctgaaaaagagcgtttattgaagaaattaaacgaagtttggagaaaaaatggcttaaaaggctatagaaaattagatgatgaataaaatttgttcattcaaataatttnnngcaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaactatttttaattttgaagtcttaataggtgcttaactgaaaattcattattacttttttaagtagtattttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaaatagtacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttactgaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaaacgaaaggtgtagtgtaaataaataataactaagacataaatgattagttattaaattatgatgaaatggggatatagctcagctgggagagcgcctgccttgcacgcaggaggtcagcggttcgatcccgcttatctccaccacttatcattgttaagtaaattagaaaaagacaaattaataaagtattaaggtagtgattaagctattttaaatattaggttattttattcttagttttaagtttaattttaaatttaattttgttttagtttatttaacgatgataactgaaaagttttatcaactgttctttaaaaaattggaaacaagctgaaaacaagagattttcgagagaaagtctgagtaggcaaaacagtaaagtgaaagagagaactgaaaaggaaactctaaaaacaaaacctgttttgtaaaaaaatcttgattgaacaaaagcaatcaagtgtttagttgaatgaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcaatatagtgaggagaatgtgttgggaagcacaatcaaagagggtgataatcccgtatctaaaaaccatattgtggtactaagctaacgagaagtagggcgggacacgtgatatcctgtttgaagaaggggggcccatcctccaaggctaaatactcctgattgaccgatagtgaaccagtactgtgaaggaaaggcgaaaagaaccccggtgaggggagtgaaatagaacctgaaaccttgtacgtacaagcagtgggagcgagggcaaccttgtgactgcgtaccttttgtataatgggtcagcgacttatattttgtagcgaggttaaccgaataggggagccgaagggaaaccgagtcttaactgggcgaatagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctagggggccatcccggcttaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcagaatttattctgttgggtaggggagcgttgtgtaagcggaagaaggttcatcgagaggtgggctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtaagggctagcccctgaaggttgaaccggtcgaagataccagctggctgcaactgtttattaaaaacacagcactctgcaaacacgaaagtggacgtatagggtgtgatgcctgcccggtgctggaaggttaattgatggtgtcatcgaaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgtaggatgattgattggggctgctcctagtacgagaggaccggagtggacgcatcactggtgttccggttgtgtcgccagacgcattgccgggtagctaaatgcggaagagataagtgctgaaagcatctaagcacgaaacttgccaagagatgagtcatccctgactttaagtcagtaagggttgttgtagactacgacgtagataggttgggtgtgtaagtgatgtgagtcattgagctaaccaatactaattgcccgagaggcttaactatacaacgctcaagtgtttttgggagctaagtgaagtaagagatgaaaagcgaagcaaataaaagcagagcgaaagagaagtaaaagactaaacaaagaaaagtaaatatagaagacttaatagaaagaaaatcggattcagcttgtgaccaataagaacgagtgaaaggtagaggaaagactgagtaacgagagataaaagagacgagagataaaagagaaaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttttatttttttagtttattcattgagtaaattaaaaaaataaaaaatttttggcagagatagtgcaatagatccacctgagaccataccgaactcagaagtgaaatgttgtaacgctgatggtagtgtgggggttccccatgtgagagtaaggcactgccaatcgtcatttttagcggagtggtagttcagctggttagaatacctgcctgtcacgcagggggtcgcgggttcgagtcccgtccattccgccaattcatatcatagtttattgataccaataggggcgtagttcaattggtagagcaccggtctccaaaaccgggtgttgggagttcgagcctctccgcccctgccataaaaaacctttcattttcaataatttactacattgtaaaaattctcttgtgagaaattatcgtctgtgacatttattcataaactttattatgtgatcgcatttaaatgcgtaggaatataataatttctaataattaattttgttgtaaggaataaaaatggaagagtccctagaattagaaaaattgccacgaatcattactgatgtattgaaaatcgtgctttgtacagcgttgattgcgctagcgattgtgcttattattgtccttgtaaaaataacttatactttatctatgatggtgcttaacacttcgtctgttgtaccttatgatgttgctgaacaagcagtaatgtttttcttatatttcgggtttattggtttgattgtgcagtattttaaaagcggatatcacttccctttacgctatttatttatgctgggatcactgcgatgttgcgtttaatcattgttaatcatgaaagctcgatggataccatcttatttgcaggcgtaattttgattatggtgatcgcactctgtttggtgttatattctaataaactgagaaatatatagttttagattcaaaacaacaaaaaacgcacttcatttgaagtgcgttttgtctttttagttgagctactcagatttgctttctaaaagtgcggttgaattttcttctgttttttcttccgcactttctggaatgacatcctgaattgccatcactgatttcaaactctcttggcgaacttgttcagctaatgctttatcgcccgcttgttcaaatacataagatgccatcatcaaatcattttgttctaattgttcagggcaagcgatcacgtttttgaatacatctgctgctttaataaattcattgttacgaacatataaataacccaaagcacgattgatacagcatttttgtttttcatccacacgttttgcacgtttttctattagcttgagaagtttactgttatcttctggttgtaaacgtgtaatttgagtacaaagaggtaaactgattgctgtattgtcaccgagttttttcagtatttcaaatgtcaattcagtagctgattcatgatcattacagtcaattaaacgttgaataaggctaattttaagttcaatattgttacggcgatgacgaggttgctgattccaccaagttagtaagccatcaattccttcttcgttcattttctcgtcgagtaaaccattttcggttttagagcgaagatctttgaattcttcatcattgaataaaccgctattcgcaacattgtctaaaattttatctagagcttgataggctttagagcgaagataaatttctaccgcgagttttaatacttctttattgcgacgagccatttctaataagctatctacagaactgcgcgctgcaggtaacttgttttgttgcaataaaatgcgagtacgggcaatttccacgagcaaattatcagagccggctaattctgttgcttcaattaaatagcgatttgcactaaattcgtcgccacgttgttgagcggcttctgctgctttgatgagatttagtacaggttcagcagaatgtttagcatttttgccaattaatttttctgctttagcgtaatccccttcatccatttttaccaagccttcaagggtttgtttttgcgcttttacacgtttgcgattagaaaaccattgataagagctacgacttaaacgaaagaaacgagtgacgccccattcaaaagcataaattattgctaaagaaataatgaaaaaaatcactaaggtagtgatggacatttctataatacgatttgctgtctcaatgcgtacataaccttgctgaccagaaatataaggccctgctacaagtcctacaagcaatgtcagcattaaaaagagcactctaaacatagacttatccttattgttgtgattcagattgtgttggtttaacagcttctacttgaggcattgtatcaatcgccttgtctgcttcaatttccactttttgtacatctaaagctgtacgattaagatatttgtcaagtaatgttaaactttttaattgctctggtacatctacataaatagaagtatcagtcaatccatctactaattttaagaaattttgtgttacttcagcgtttgtatcaaaatagctacgaacccaagaagaaacagcttctagagattgcttataaagttcattttgctgacgaggaactgccataatcgcaagctgtaaacgtagacgaatgttctcacgaagataaatatcttgatttggtgcaagtaattcttttttatttgaattttgttttggcgaaatacgaataaaatgatttaggaaagaggttgcgcttttttcaatattttgttgccagtcagtaatgttgttggataatttatcattatttttagatgtttcatcaaaatttacantcaaagcctctgtaattcatcgactgtgtttgcaagctgtgatagtttttgcattatcgcattttgatccacacttgaaagcgaaagaagttgttttaaatcttgattgattgcactacgaatttcatttgcttgtgaattattaaccttgacgagggtttcatcagctaattttaataaagaaaccgctgtatcaacatcgttatctaaaacaagtttacgcagggcattatttagtaaaaaatcagcttcggaaaataaccaatcgcttggttgttgtgcgatggcaagctgacttacttgtttcatttgagtttgtaaggatgttatttcccctgttttgcttacaattaattgttccagttgagctatattttcttgtgcagtttttaaactctgttctaattgtgtaagtcgtttattgttattggtgttatttgaggaaagatttgctcccgtttgattttcaagtgcggttaatttctgttgaattttagccatttgctgctgaccaaaatagtatccagctccaccaatacctagcgcaacaagtattgctaataaactcaatgctgtaccagtttttttcacaatagtttgcggaacagactgcattgtttcagcttgttcaacagctgttttgggcgtatctgtaagttgttcggtgaggtcgttaggttgctcttttgccatatcaattccttaataagtgatattgagtaaggtattttataatactttgcgttgataagaaaaatatcaagctatccactaataatagaaaatatagatttttatatcggcagaattaagctatttacgcaataaaactaggtactatcctaccactcttaggtaaaaaagtcattttgattgttgataggtaaaatttatagtatttttcgaaaaattgtgatttatgtcacatttttttgcatttatactccctaagtggtaaattgttcgccaatttttgttgttctggtagggacaccacgtggaatgtaatctagcacaagcaaaacaatgggttagcgccttggatcaacgccgttttgagcgtgcattacaaggttcaggcgatgcattccaacacgttttagcgattgtccctttacttttacacctaaaccatccacaacttcccggctatgttattcacgccccctcaggtattgcaagtttcctcgcatctgattatcaaaaaaagtggctcaccaatgaatacggtattcattatgccgatcataaaccatcaacactcaaaagtgcggtaaattttcacgaagtttttccaccaattttaggtgtttatgtaatgggtagctttggctcaataagtcaaacctcttcttcagatcttgatacttggatttgtgtccgtgatggcttgagtctagatgaatatacacttcttactcaaaaagccaagcggattagtgaatgggctatgcaatttaatgtggaaattaatttttatttgatggatcaacaacgtttccgcaatgaacattatgctgacccactgactattgaaaatagcggctctgcgcaatatatgttattgcttgatgagttctatcgctccgccgtacgcttggcaggtaaacctctactttggttgcatttatgggtggaaaatgaaaaagactatgaaaaagaggtggcacgtttaattacggaaggggaaattgatccaaatgattgggtagatttcggcggtttaggacaattttctgcaaacgaatatttcggtgccagtttatggcatctttataaagggattgattcaccttataaatctgtgctcaaaattttgttgttggaagcctattccaaggaatacccaaacacttgcttaattgcccgcacttttaagcgagatttacttgcaggcaataccaatcctgatcaccattttgatccttacattgccattcttgcaaaagtaacccaatatttaaccgcactttctgaatttaaacgtttggattttgtgcaccgttgtttctatgtgaaagcaacggaagattttgcacgttaccaagccaataattggcgtattcgttatatggaaatccttgcgcaagaatggggatggtctgcagaaacggtaaaacatctcaataagcgtccattttggaaaattaaggcagtaaaagaaaaccacgataacataatgaaatttttaatgttgagttatcgtaatttagtggaatttgctcgaaagcatcacattcactcgagcgtcgtgccacaagatatcaacattctttctcgtaaactttatactgcttttgaagaacttcccggcaaagtgtccttactcaacacacagatatctcacaatttatcagaagcacacctgacttttgtggaagttcgcggcaataaacattttaaggatggttggtaccttatcaatcaaccaatacaccatattatgttctccaaagaacgggtgatcgaatacggagaaagcctgaataaattagtttcttgggcttatttcaatcatttactcactgaaaaaaccgaattgtcaatttttagcaagaatgtgactttaagcacattacaacgctttgtcactaacttgcgtcagtcttttccaagcaccatcgctaaacaacctaaaaacagcgatttattaaatcaatgtgaaattcgtagcttgtttattgccataaatctcacgaccgatccaacatccaaagtagaagaagtattaacgggtatttcatcgcgagatttatttagttttggatccctcgagcaaagccttgtgggcagtatcgattttacttatcgtaacgtgtggaacgaaatccgaacgctccattttgaagggcaaaatgccattttgcttgcgctaaaagtactttctaacaaaatttatcgtggtgttaatcgcccagattcaatccaagtctattgttatagtgaacgttatcgccaagatttacgtcaattagtgatgggattagtcaatcgatgcgttagcatccaagtcggcgatattcaacaaccttgccaaacgtcacgtttacgcgtagcgggtaaaaactggcaattattttttgaagatcgcgggattagcttacaagaaatcggaaatgaatcggtctgtaatgaagctgaaagtgcggtggattttgacgaagttttacaaacaccaattgaagatggcgagacaaaccaagaaagtcgtcgctatccaccagaaatggatgccttcgccagtgaaggattcctacaattcttttttgaagataattctgatcacagcttcaatgtttatattttagatgaatctaatcatctcgaaatctatcgccactgcgatggtgaaaaagatgaaaaagtgcgggagattaatcaactttatcaaaacgccaaacaggaaggcgataaaaatccttacaatatcgttcaacataattttaactaccctcaattttatcaactacaaaatggaaaaaatggcatatccatcgtgccgtttaaattccgccaaatgaataagtaatattttcctgtggttgataggttaccgaaagatatctatacttatttcctcttttactagataaattgtagatatgataacttcgcaaacaccaatcactgtgctaggtgcgggatcttatggaactgcgctggcaattaccttttctcgcaatggttctcccactcacttatgggggcacaatcccgcccatatcgcacaaatgcagacagaacgacaaaattatcgttttttgccggatgtcatctttcctgaggatcttcatttagaaagtaatcttgcacaagcaatggaatattctcaagatattttaatcgtggtgccaagccatgctttcggtgaaattcttataaaaatcaaaccgcacttaaaagcccatcaccgattaatttgggcaacaaaaggtttggaacgtaacacagggcgtttactacaaaccgtagttgaagaacaactcggaacgcaatatccactagctgtactttctggcccaacttttgcaaaagaattagcgcaaggtctaccatcagctattacgcttgctgccaataacgagcaattcgcacgggaatttcagtctcgtattcattgtagtaaaggtttccgagtttatataaattcggatatgactggcgttcaacttggtggagcaattaaaaatgtgatcgcaattggtgcgggtatttcagacggtatgggatttggcgcaaatgctcgcacagcactgattactcgaggtattgcagaaattacccgcttaggtatctcgctcggtgcaaataccaatacatttatgggaatgtctggattgggcgatttagtgctaacttgcaccgataatcaatcgcgcaatcgacgttttggattaatgctaggtaaaggattagatgcccaaatggctatggaaaatatcgggcaagtcgtagaaggtttttataatacaaaagaagcctatttgcttgcacaaagacaaggtgtggaaatgccgattacagaacaaatttatcaaatgctgttttgtggcaaaagcgcacaagatgtagcaatcagccttttggggcgagcatgtaaaggcgaataaaaggagaaattatgacattagatgtgtggcaacatattcgccaagaagccaaagaacttgctgaaaacgaacctatgcttgctagtttttttcactctacaattttaaagcatcaaaatctgggcggtgcgctaagttatttattggctaacaaattagccaatcctattatgccagctatttctctccgtgaaattattgaggaagcctatcaatctaatccttcgattattgattgcgctgcttgcgatatccaagctgtccgccaccgagatcccgctgtagaattgtggtccactccattgctttatttaaaaggtttccatgcgattcaaagttatcgaattacccattatttatggaatcaaaatcgtaaatcccttgccctttatttacaaaaccaaatttcagtagctttcgatgtagatattcacccagcggcgaaaattggccacggaattatgttcgaccatgcnacaggtattgttgtgggtgaaacatctgtaatcgaaaatgatgtttcaattttgcaaggggtaacgcttggcggtacgggaaaagaatcaggcgatcgtcatcccaaagtacgcgagggtgttatgattggggcgggtgcaaaaattctcggtaatattgaagtaggtaaatacgccaaaattggggcaaactctgttgtgcttaaccctgtgccggaatatgccacagcggctggcgtgcctgctcgtattgtgagtcaagataaagcagcaaaacctgctttcgatatgaaccaatattttatcggcattgatgatggaatgaatttaaatatataaggagacaccatgatcaacaaagatacccaactctgcatgtctttatcaggtcgtccgagtaatttcggtactacctttcacaattatttgtacgacaagctaggattaaatttcatttataaagcattcaccacgcaagatattgagcacgccatnaaaggcgntcgtgcattaggcatccgtggttgtgctgtttcaatgccattcaaagaaacttgtatgccatttttagatgaaantcatccgtcagcacaagccattgaatccgtaaacaccatcgtgaacgataatggctttttgcgtgcatataacactgattacattgccatcgtaaaattaattgaaaaatatcatttaaataaaaatgctaaagtcattgttcatggcagtggtggtatggcaaaagccgttgtggcagcctttaaaaattcaggttttgagaaattaaaaatttacgcacgcaacgtaaaaacaggtcaatatctcgccgcactttatggctacgcatacattaattctttagaaaaccnacaggcagatattttagtcaatgttacgtcaatcggcatgaaaggcggcaaggaagaaatggatttagcctttccaaaagcgttcattgataatgctagtgtcgcgtttgatgtagtggctatgcctgttgaaacgccctttattcgttatgctcaagcacgaggaaaacaaactatttctggcgcagcagtgattgtacttcaggctgtagaacaatttgaactttatacgcatcaacgcccaagcgatgaattaatcgctgaagctgcggcgtttgctcgaacaaaattttgaaataaagatatggtacattgtgttttttattaaaatttgttgctctcgatcacatttctgaatattgctcgttgcatctttataacattcatttaacattgaaccctatttaagtgatagctctaacggaggaactttatgggtgagatggcatctttaagaagtcataaaaatggcattatttttattttagatattgtgctgttttttgtgttattaaatgtattaccttttgaaccaaaagctaattctggtttggcattattagcttttatcgcggtgctttggttaagtgaagcattacacgttactattactgcattattagttccacttttggctgtggcattgggattagttagtaccaaacaagctttagttggttttgctgatccgacaatatttttattttttggtggcttttccttggcgacggcattgcatattcaaaaacttgataaattgattgccaataagattatggcactagcacgcggtaatttatttatcgcagttatttatctctttttgattacagcctttctttctatgtggatgagtaacacggcaactgctgcaatgatgttacccctcgccatgggtattttaagccagcttgatcgcgaaaaagatcataacacctatgtgtttgtgctgttagggattgcttacagtgcatcaattggtggtatgggaacccttgtaggaagcccaccaaatgcaattgtagcaagtaatttaaatttaactttttctgattggttatggtatggcttaccaataatgattattttgttgccgttgatgattgggattctttatattattttcaaaccaaaacttcatctcaattttgaacagacctttgaaaatattgaaatgaatcctatgcgtatattgacgtttattatttttccagtcattgctttaacgtggatatttagcggtaaaattaatccgtttatttcaggattactaggattacaaaaaaacattgcaagttttgatagtatcgtagccttattggcggcaattgttatttgttcaacaggcgttgcaagttggaaacaaattcaatcaaataccgattggggcgtattaatgcttttcggtggtggattaacattaagtgcggtgttgaaggattctggtgcaagtaaaattttagcggatagtattgtttttatgattgatggacaacatttctatcttattggtttattagttgcggcgttcattattttcttaactgaatttacttctaatacagcgagtgcggcgttacttgtacctatctttatttctatcgctcaatcattgggtatgccagaaattggtttagcattaattattggtattggtgcatcctgtgcctttatgctaccagtagcgacaccaccaaatgcgattgtatttggctctggtcaagtaaaacaaagtgaaatggtcaaagttggtttcttactgaatttagtctgtgttgtagttattgccactatgggttatatgttctggcttaaataatatagaattgtttacttttaataaatgatgattgaagatcataaatttaaacgtaagaagtacaataaagccatttaaataaatgggttaaagcaaatgaagctttaacccatttttcataaccgttctatacaaagctatttattgtgttcataagcataaagcgtattgctcatcaacattgcaacggtcattggcccaacgccaccggggactggtgtaatgtaagccgctttttcggctgctttatcaaactctacatcgcctactaattttccatctactcggttaattccaacatcaattactaccgcactttctttgatccaatcgccagaaattaaatttggtttacctaccgcaacgacaagtatatctgcttggcgaacgtggttttccaaatttttagtgaatctatgtgttactgtgacggttgcccctgctaataataattctaaagacattgggcggccgacaatattggatgcgcctacaattactgcgtgcttgccgtgtaaatcaatacccgttgtttctaatagtttcatcacaccataaggtgtacaagcacgtaaagttggaatacgttggcataaccgcccaacattataaggatgaaagccatctacatcttttttaggatcgatacgttcaataatagcttccgcattaatttgttttggcaaggggagttgcaccaaaataccgtcaatatttttatctgcgttaagttggtcaataatcgctaataattcattttgcgtggttgtttcagggaggtcataagatttagagagaataccgacttcctcgcaacttttacgtttattgcccacataaatttgcgaagcaggatcagcaccaacgaggattacagcaagtcctggagcgcgttttccttgttcaatataatgggttattttatctgctaaattagctttaatttgttttgaaagttcagtaccagagatgatttttgcggccattgagctatccttgatattatgtgatgaaaaagaaagcgtttgctattttaacgaacaatgatttttttacaatgaaaaagggggatatttcttaaagtggaataattttgaacaattaagttgaaaaatcaaaaatttcattgactgaaataaaaacaaacttataattgaccgcacttatcggcgagtagcgcagcttggtagcgcaactggtttgggaccagtgggtcgtaggttcaaatcctatctcgccgaccacttctttcgtattttcttgaaatttttataaaagaaatcctttgaatgcgcccttagctcagctggatagagcaacgcccttctaaggcgtgggtcaaaggttcgaatcctttagggcgtgccattcgttanctgtttaacnagatcctgtttagtttttccaaanataagtactttcagtctgtnagattttatgctcataanctgcatcatttgagtgaagaagcttaaatacactcttaatgatgcagataaaaacaatattttggctatttaagtattttccaagctctgaagccataaatggcaattactacaaaacagattaatggtaggataaaggaaaaatttactgctggaagtcccataacttcgccttggtcaataatcattccttgtagtggtggcattaatgcgccgcctacaatagccattactaaacctgcagctcctaatgtcgattcctcttttaagccatagagggcaataccataaatggtagggaacattaaaggcataaaacctgaggttaaaattaggcagtatagaccccatacaccgtcaataaagataactccgagaatacttaaaaaaccaccaatagcaaagagcatcagcataaattctgcttttaaatatttcattaatgccgtgctaataaagcgactgctaataaaaatagccatagcaatgatgttaaagttttgcccttcagctttagtaaaacctaaacgttcagcgtattgtacgataaatgtccaacacatgatttgaacacctacgtaaaaggcttgtgcgatcacgccttcacgatatttggctttttgagccagtcggcttactgctgttttaaagctgatttgtccggcctcttctatttttacggctggcatttttttcaatccaatgataataaacactgcaaccacgacaaaaccgagtgctatgtaaggatcgcgaatttcagctaaatcatgggtgcgaatactcattttttctgcttcagacagggtgtggaaaatcaaattacctgcagcatcacgtttgtcagattcaagattagttaggactaactgggaagcaacaaacatacctgtaattgaaccaagtggattaaatgattgtgcgaaatttaaacgtcgagtagctgtttgaggatctcccattgcgagaatataaggattggcagtggtttccaaaaaagcgagcccaaaggttaaaatataaagggagactaaaaagaaattaaatatttcatattgcgcagctggccaaaataaaaatgcacctattgcataaagagcaagccccagaagaatccccgctttgtagctatagcgactggcaaataatgccgcaggaatagccattgtgccgtatcctccataaaaagctaattgtaccaatgccgcttctgaggctggaatttccattactgtttgaaataccgcaaccatcggattggtaatgtcgttggcaaatccccaaagagcaaataagctagtaataagcacaaaggggacgatgaatttcttttctaaaactttggcgttcataatgttttcctcatgtaagtgatggggtataacaagatttaggattcttcaatacgtaatccataggtgtggaatttacctaacactacctgcatttgctctttgctgagcagtggaatttctaagcctgtagagagtaatttcaaataccaagacgctaatacttctacttcttgtgcgagccataaggctttatctaggttttctccgcaagtgattaaaccatggtgtgctagtaaaatggctttgctttctttgattcccgttgcgacataactagctaatttgtgactaccaaatgttgcataaggtacacaaggaatatgatctgtgccgcttacggctaccatgtaatgaattgcaggaataggtttttcgagaatggataagcctgcacagtgaatggaatgattgtggacaacggcatttgcttcagggcgagtatgataaacactcaagtgaaattgccattcgcttgatggtaatttattttcttcgtgtttgccatttccatcaacataaacaatattttctgtcttcattaagtgatatggcatacctgtcggggtaatcagcattccatctttataacgaacactaacgtttcccgctgtgccttgatttaaacctaattttgtcatttcaaggcaagtatcaatgattttttgtgataattctgctctgttcattttgtagtacctctattgtttataaaatgggagtaaccccttttttaatgataatgttgccatattttgcgatctcaccactgacaacaacagcataagcctgtttagcacgtgtataaaaatcgaagcgttctagacaggttaaatttggtgtgaaaccgaccgcactttcaatcgcatttaagtaacgagtttcaacattcggatctaaagaatctccctcaactgctttcatcatcaacagaggggcatcaacataagcgtcaaattcgaataagggagttattgcttcaagtaaaatatctatagatataccatctgcacgtattacatttttatgtagtgaatgtgcgggaaaatgggcgtcagctagaactatctcatcgccatgccccatttcggcgagggtttttagtaattcaggagaaagagctgggtgaataccttttagcattttgttgttccttctagtttgggtaaattcgttttcttgttggttgcatcgcttgctgtgccgcgtttacattttcgtaaatgcctacgcctgcaaaggtaaacattgcggcaccaagtacagtactttcagaaatgtccacaacatcaatcggtaaatttaaggtgtttgcacggatttgattccacaatacattttttgaaccacccccaacacaaattaagcttttagcttggaactgactgacttgatgtagcacggataaaccgtttttgagtttatttgccatatgttgtaatgcgctgacataaatttctccacgagtagcaaacatggaaagtccactgatattaccttgtcctagttggctaaaaataccttcaaaattgaccgctctttttcccgcattaaaagctttttctccctctttgatcattgtggtgtaatagtgatcgctgccataaacatcggaaaataataatttacctaaccattctatgacgccagaacccacccattgtaccgctggattaaagcaattggattgtgcatcaaattcagtggttaagccttgagaaacaaactcaaatctaggttctgcgtgctgggttctagccattaagatttcccaggtgccagaacttaacacaggctgattcagccctgcaccagacccaaacacagcaaattgagtatcatgtccacaagaaatgacaggtacgggatttaatccccatttctgggctaacggtgtacgtaattttccaactttttcacctgcataacgcataggagggaaatggttattacttaaacctagcgatgctaaaatcgatggatcccaattaccgctagtaaggtttgtcatcattgatgttcccgccattgtgtgatctgtagtgaattgaccagttaagcgttgagtgagcattgacgaaataaaaacgaatttagccattttttggaaaacatctggcttgtgtgtttttaaccaatgtaatttaaataaagtattaaaactgtattgaccaatgccgttacgttgataaagagatttgatatctaattgattagatagattttccattactggtatggtccgtgggcatttccatgaaataatcggataaagttgttgatcattttcatcaaaaggtgcgccatccacgccgaaagtggtaacagatattcctacaatatcttttaaatcaataccttgttgcattaattgattgagggtttgagttgcacaagaggttaatttttgccagatttcttcaatatcccaaatatgataatcagatgattcgattccttgttttgtattattagcaaggtgatgagaggcaagaatttgtcctttttcatttatcgcaatggtgcgtaaatttgttgcaccacagtcaaaaatcaatgcgatagccataaaaactctcctcagcgcagtcaaaaatcattatgtttttgaccgcacttttttataaaaacaaattaggggttatttataaagcggaccaaagttttggcaagctcgataatcttgcccttccttgtcttgaccaaatccattccaagcgctagggcggaaaatatttttctctgatacattatgcatacagactggaatgcgtaacattgaagcaagagtgattagatcagcccccacatgaccgtgagtcgctacacagtgatttgcgccccaatttgccatgactgaatacacatcagtaaatgcaccttttccagttaaacgtggaacaaaccatgttgttggccaagtttcattagtacgttgatttaatttattatgtacatcttgaggtaagtcgattgaccagccttccgcaatttgtaaaacgggacctaaacctttaataagattaatacggtgtattgtaaacggtatgccacctttggttaggaattgagaagataaaccgccccctcgaaaatattcgtgaacagcagggcaccaacgtgtattttctaagcagcgttttgcttcttcttcggtaacatcccatgctggttttaaagttggattgccttgagcatcttgatgttctcccgttccatcaagtgcagctgaacctgaattgattaaatgaatgaatccactttcaggtcgccatccagtaacacgctcaaccgaatcttgactccaataagtacgcacatctgcgaaaatttgagctttgccagttaattgatgcccaaataacattcctattgcatttaaactatcattttccgtggcaagaatataaggtggacgcacgccattccagtcataagttgaattgagcattgcctccataaaatcgccgtttggcaaatgatcagtccaatgacgctgcccttgaaaacctgctgcaatggcattatgacctaaggcttcttctgcataatttaatgttgctaattttggatttcctaccatcaaatcacgagtgataatggtcattttcacaacattttcccaaagttctgcacgctcttccgcattgcgttgattctctaggctatttacatcaaccccttctttgcaatattgtttaacccaactcaaggctaaatcaacttcttcttgatcataaattttgcggtctaaacggcgtttaatttccatcatatccacatattcattacgcatacctaaatattcttggaagaaagcttgatttacaatagaacctgcaattcccatggaaactgacccaatagataaataggattttcctcgaatacttgcaacagcaagcccagcacgagcaaaacgcaataatttttcttttacatcttcaggaatgtttgtgtcatcggcttcttgaacttctgtgccgtaaatggaaaaggctggtagtcctaattgagaatgaccagcaagggcggcagccaagtaaaccgcacctgggcgttccgtaccgttaaatccccaaattgctttaggcatgtgaggatccatatcaatggtttctgagccataacaccaacaaggggtaacggtaatggttaatccaacgttttcgcgtttaaatttatccgcacaggcggctgcttcggctacaccgccgatagtgctatctgcaactacacattcaacgaaagtaccatctgtatgacgaatatgtgtttgtaataattgagcaacagattgagccatacgtattgtttgggtttcaagagattctcgaacccccattcgacgaccatcaatagttggacgaataccgatttttatacgatttgattgagtagcaagagccatagttacactcctttgtttgtgcttaagtaagaatgatgaaatcactgcagaacaaatggtgttttcattgaattagagtgtgaaagaaaaatgataaggaaaacagtaagaaatgaaattttgttgcaaaactgcgagcatcacaaaaattgactatatttaaggaaatgtatatgaccgattctttcaatttttagtaattttcggtcaaaatggtcatttgtttttataaaacggtcattatatcgtgttgctcacaatatttttgtaagttatcgggaagtgaccgatcagaaaaaatggtattaattttgcttaaatcggcaagttgaatcaaacttgttttttcaaatttagaagaatcaattaacaaataagcacgttctgaagcttccatcatttttcgttttaaagaggcattcagctcgtttgattcccagatattaccgtttttatcaattcctgaacaagaaaacactgaaaaattaatatgtaatcgttgtaataagtactcagataagggaccgtaaaatgcttcatattttgctgaataaactccgccagtaacaatagttttaacattggatttattaactagggcattaatgttaaacattgaattggttactactgtacaaggaatatcgggcattaaataagcaaaataccaacttgttgagcttgcatctaaacctataacggcattttcatatagcaaatccaaggctttttgggcaatatgtcgtttagctgttgcattaatatgttttcgagtttggaaaaatgaacctaaatctttggttttattactcactgctcctccgtgggttcggtgcaataagcctttgttcgctaatttgttcaaatcgcgacgaatggtttccaccgaaatatcacaatgctgtgcaagttctattacactggcttttccttgttgatttacccattgtaaaattaattcatcacgataattcatctcttttccctatacggtggatttagtcgagattctagtttacgcttgagtatattgaaaatccaaggataaattatattggggtgacgtatatcttcctaaaagtgcggtcaattttttgtgagtttcttttcaagagtatgcaagctacaatacgcccccaagttttatcaatgtaaatcagaaagagaataattatgccctttgctattggtcagcgttggttaagtgaaagtgaaaacgctttaggattaggtgttattaccgcattagatcaacgaactgttactatttatttccccgcagcagatgaaacacggatatatgctatggcgcaagcacctttaagtcgaattgtatttagcaaaggcgaaacattatcccatcaagctggctggcaaggcgagattttagacgttcaaaatatgaacggtttgttgttttatttagttaaaaatccacaagatgaagatgttattgtgcaagaacgtgatatttcgccgattatttcttttagtcaagcgaaagatcgtctgttttcagcacaaattgatcgcagcactcattttgcattgcgttatcgcacgctttgtcatcagcaagcacaatttaaatcgccattgcgtggtttacgcggaacgcgtgcaagtttaattccccatcagcttcatattgcagctgaagtcggtaatcgagttaatcctcgcgtgttattggcggatgaggttggtttagggaaaaccattgaagcaggaatgattttgcagaatcaactttttgctgagaaagtgcaacgtgttcttattatcgtgccagaaaccttgcaacatcaatggctggtggaaatgcttcgtcgttttaatttgcattttgcactttttgatgaagaacgttgcaacgattttgatcttgatgcggttaatccattcacgactgaaagtttaattatctgttcgctgaattggttagaaacgcatccaaacagagtagagctggtgctcaatgctcaatttgattgcttaattgtggacgaagcccatcatttggtgtggtctgaaacctcgccaagtactgcttatttattagttgaacagcttgctcgtatcattccatccgtcttgttactcactgcaactccagagcaacttgggcaagaaagtcattttgctcgtttgcgcttactggatccagaacgtttctttgattatcaaacctttgtgaaagagcaggaacactatcaacctgtggttaatgccgttgaatctttgttggcaaataaggcattaagtgcggtcgaaaaaaatcatatttctgatttattgcttgaacaagatgtcgagccactttttaaagcgattgcatcaaataatgatgaagaacaacagcgtgcccgtcaggaattgattcaagccttaattgatcgtcacggcacggggcgaatgttattccgcaatacacgtcaaggcgtgaaaggttttccgcaccgtgtttatcatcaaattacactctctgaagagaatgataaaattgattggctgattgacttcctcaaactacatcgcaatgaaaaaatctttgtgatttgccagacggcggcaactgcgattcagttagaacaaattttacgtgaacgtgaggcgattcgcgccgcagtgtttcacgaaaaaatgtcgattatcgaacgggatagagccgccgcttattttgcggatttagaaaacggcgcgcaggttttactgagctcgagtattggctcggaagggcgtaatttccaattcgcagcaaatttagtgttatttgatttaccgacaaatcccgatttattggaacaatgtattggccgattggatcgtattggacaaaaacgtgatgtgcaagtttatgtgccttgtgcgaaagattcgcctcaaagtcgtttagcacgttggtacaatgagggattgaatgcttttgaacaaacttgtccaatgggaatggcattattttctcagtttgccgatgagttggaaaaagtgcggtcaaattctaccgcactttcagagaatgaattttctggattattaaaacaaactaaaaccgcacgggaaaaactcaagattgagttagaaaaaggtcgtgatcgtttattagagctaaattctcatggcggtgagcaagcacaagcattagcggatcaaattgctgatgaagataattcgccagagcttgtgaattttgctttaaaattatttgatattattggcgtagagcaagaagatcttggggctaatagtattgtaattagtccaactgggacaatgcttgtgcccgattttccaggtttaaaagaagaaggtgtgacggttacctttgatcgagaacttgcccttgcccgcgaagaaatggagtttctgacttgggatcatcctatgattcgtcaaggtattgatcttgttgcttcgggggatattggcaaagccgcaatggcattgcttgtaaataaacaactgccagctggaaccttattaattgaattgatttatgtggtggaaagccaatcgccaaaagggttgcagctcaatcgtttcttgccgccaacgcctattcgtctgctgcttgataacaaaggaaataacattggtgagcaggttgcctttgaaaccttgcatagcaaattgaaaccacttggtaaaaatattactaatcaaatggtgaaaatggcacggagcaacattgaatccttgatcatgcgaggtgatcaactcgtaaaatccttggcagaaccgattattgctgaagctaaaaatcaagcagatcaacaattaagcgcagaaattaaccgtttacaggctttgcgagcagtgaataaaaatattcgccaaagcgaaattgatattttggaacaacaacgaacacaatcacttgacgagctttctaaagcaaattggcgtttggattgcttgcgtgtcattgtgacgaacaaggaataaaaatggcattgattgaatacaatccgccccttgaaccttatttggatattatttatcaagataatcatttgtgcgtggtaaacaaaccgagcggtttgctttccgtgccgggcaatcaaccacaatattatgatagcgcaatgagtcgagtaaaagaaaaatttggcttttgtgagcctgctcatcgtttggatatggcaacgagcggtattattgtgtttgctttaagtaaggcggcggatcgtgaattaaaacgtcaatttcgcgaacgtgaaccgaaaaaacactatcaagcgattgtttgggggcatttggagaacgattatggcgaggtaaatttgccgatgatttgtgattgggaaaatcgacctcgccaacgtttggatttcgttttaggaaaaagagcggtcacaaaattcgaagttttagcacgtttgccgaataacagtactcgcgtgaaactgacgcccgtgacaggcagatctcatcaattacgcttgcacatgttagcattggggcatccaattctaggcgataaattttactctcatccacaggctaaagttatgtcgccaagattatgtttgcacgcagaagaattgacgattacccaccccattacaggggaaacaatgacttttaatgcgaagtccgatttttaaatttacgcataagcacgagatcacgaatgaaaaactttttagctcaacaaggaaaaatcacgctaattctcaccgcactttgtgtgcttatttatcttgctcaacagctgggttttgaagacgatattatgtatttgatgcattaccccgcttacgaagagcaagatagtgaagtgtggcgttatatctcacatacattggtacatttatctaatttgcatattttgtttaatctgtcttggttttttattttcggtggaatgattgagcgcacttttggctcggttaaattattgatgttgtatgttgtagcatctgccataacaggatatgtgcaaaattatgtgtctggccccgctttctttgggctttctggtgttgtatatgcggttctaggttatgtatttatacgtgataaattgaatcatcatttatttgatctgccagaaggtttttttacaatgttattggtggggatcgcattaggttttattagccccttatttggtgttgaaatgggaaatgctgcacatatttcaggcttgattgtcggcttgatttggggatttattgatagcaaattgcgcaaaaattcgctagagtaagtccgtttaatttggataaaggattcgctatgaaacaatcgttacgccatcaaaaaattattaaactggtggaacaatctggctatttaagcacggaagaattggttgctgccttagatgttagccctcaaacgattcgtcgtgatttgaatattttggcggagttagatttaattcgccgccatcacggtggtgcggcatcgccatcttctgcagaaaattctgattacgtggatcgtaaacaattcttttcattacaaaaaaataatattgcacaagaagttgcgaagttgattcctaacggtgcatcgttgtttattgatattggtacgacgccggagsstgtcgccaatgcgttgcttggtcatgaaaaactcagaattgtgacgaacaatctgaatgccgctcatcttttacgccaaaatgaaagttttgatattgtcatggcgggcggatcattacgaatggatggtggaattatcggcgaagctacggtaaattttatttctcaatttcgcctagatttcggtattttagggattagtgcgattgatgcagatggttcattattggattatgattaccatgaagtacaagtaaaacgagcgattattgaaagttcacgtcagaccttattagtggccgatcactctaaatttactcgccaagcgattgttcgcttgggcgaattaagtgatgtggaatatttgtttacaggtgatgttcctgagggcattgtcaattatttgaaagagcagaaaacgaaattggttttatgtaatggtaaagtgcggtaaaaatatctttgattttcttattaatttgtcgataaaagaagctattactcttaatttttgatttaattgaaatttatctaaaagtaatctaaatattctctcgctgaattattgtcttttctataattaaacatttccaagcgtaaaagtatcttgcttttttaatcaattaaagaaatttcatatttctgtattatctaattatttttagctaccaatattctttaaaacattccgagcttagataagaaaatcccttgctgggcaagggatttagtaatgggttaaagtgcggtagaaattaccaaccttttacaacgccatctttaaagtgtttttgagcttcttggtaaacttcttctgtttggtaagattttatgaaatcttgaacagctttgctgtctttgttatcggtacgagaaacgataatgttcacatatggagaatctttatcttctacaaatacaccgtcatcttgagcatttaagcctacttgacccgcataagtattgtttactacagctaaatcaacgtcgtctaatgcgcgtgccgcaacagaagtatctacttcagtgatgtttaattttttcggattttcaacaatatctaatacagttgaaagaaggttatttgcatcttttaatttgattaaaccttgtttttcaagaagaattaatgcacgaccacggtttgttggatcgttaggaacaacaactttagcaccgtcttgtaattcattcacatttttgatttttttagaataacccgctaatggatagacgaaagtattacccacgataactaagttatttaaatttttcgcttttgcatcttcatctaaataaggtttatgttgcattgcgtttgcatctaaatcacctttagatacagcttcatttggtaatgcgtagtcattgaattcaacgaattgaacgtctaaaccatatttttctttagcgacttttgctgcaatttctgcaacttgatgctctgggccagacatcacgcctactttgattttaagcggtgctgctgcagcttcaggttttttgtcttctttacagcctgttaaaacgagagctgatgcgattgcagtgattgcaaaaagttgttttaatttcataggatttccttcctgtttaagttaagagttgcgtttaattaacgatgatccacttttttagccagtgtatcgccgagtttttggctaatcataacgaatagcacaataataatggttgccacccaagttacataaggcatattgcgatatacgcccgtagttgatagcgaggctacctaaaccaccgcccccttgtgttcctgccattgcagaataaccaactaaagtgactagcgtaagagtaacgccattaattagcgtaggtagagcttctgacaaatagaatttacgaacaatttgccatttagtagcccccattgcttgagctgcttcggttaaaccatttggaatttccattagtgcattagcagttaagcgagccacgaatggcattgcacaaatactcaatggaataattgctgctgttgtacctaatacagttcccacgatgaaacgagttacaggtaataagattaggagcaaaataataaatggaatggaacgcccaatattaataatcgtgtttaacacaaaatgagtgcggttattttgtaaaatctcattttttccagttaaaaaagtccatatgccaacaggcacgccgactagtacagcaagtagggtagatgcaaaactgatataaacagtttcataagttgcggttgcgacaacgccccacatttgaggtgttaattgctggctgaatgttgccaaaaaatcattgaacataaccaagcacctccacgcgcacgttgttttccattaaataaactttggtttgcgtaatggcatcttcatcgccttctacttcagcaatggtataaccaaatttcacgcctccagcataatcaatttgtgaggttaagatactgagctccacgccaaatttttttgatgcttgagaaagtaacggtgcatcgactgagcgacccgtaaactcaaatttgatgattggataggctttactatgtttcggtgtatcagtaagattttccaaatattcatcaggtagactgatgtggaaggtcgaacgaataaactcttgtgctaattctgttttagggtttgcaaaaatttcaccgacagtaccttgttcaactaggcgaccttgatcaatgacagcaacttgatcacaaatctgtttaacaacttccatttcatgagtaatcaataaaatcgtaatacctaaagtgcggttaatttcctttaataatttcagaatagattgcgtcgttgcaggatctaatgcgctcgttgcttcatcacataataagactttaggatcgctcgctaaggcacgtgcaatggctacgcgttgtttttgcccgccagaaagattgcttgggtaagcatcacgtttttcacttaaaccaacaagatctaaaagtgcggtaattttttcttggatttttgcttttgactcactttccaattctaagggtaatgccacgttttcaaagacggtgcgagaacttagtaaattgaaatgctgaaaaatcattccaatttgacgacgagcaagtactaattcgcgatcagaaagttttgttaattctacgccatcaacaataacggaaccgcttgtcggtttttctaataagttcacacagcgaattaatgtactttttcctgcaccagatgcaccaattacgccacagatttgacctttttcgatattcaacgaaacattatcaagngcagtcaattttttgntcggtagctcaaaaattttcgnaatattatttagcttaatcatataagccctttttatttattgtttttaaatctgttttggtattctagatgtctagattgctatgtcaatatgtcagattatcttttttagacagattagttatgacttatatttgctaattgcttggattaaatagataatttttgtcaatttgacatgtataaaaggtaagagaatgaataaggctatttttttagatcgcgatggcacgttaaatattgattatggttatgtacacgaaattgataactttaaatttattgatggtgtgattgatgcattgcgagaattaaagaaaatgggatatatgttggtattagtgaccaaccagtcgggcattgcacgtggttatttttctgaggatcagtttttacaattaacagaatggatggattggtcgttagctgaacaagatgtggatttggatggtatttactattgtccacatcattctgagggaaagggcgaatataaagaagattgtgattgtcggaagcctaaatcgggaatgttattgcaagcgatcaaagaattaaagatcgatcctacgcaatctattatggttggagataaagttgaagacctaaaagcggggattggtgcgaaagtaaaaatgaacgtattagttcgtactggtaaaccagtaacaggggaaggagaaggaatagcggattatgtgttagattctatcgtagatcttccgagaattttaaaacgcttaaaaaaatagccaaaaagatctatattttgctctaatcgcttgtactttaatcaaaagatcatttttttaaatatttttacaaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaactatttttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagtacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttactgaagacgagagacagcgagtgctcacacagattggctgatagttgtagacaagattaaaaacgaagcgaaagcaacgttgaaaaataaacgttaaaagataaaaagaaaatagagtatctttaattgatgtccccatcgtctagaggcctaggacatcgccctttcacggcggtaaccggggttcgaatccccgtggggacgccaattaaagataactttattagattgtcttactgttctttaaaaaattggaaacaagctgaaaacaagagattttcgagagaaagtctgagtaggcaaaacagtaaagtgaaagagagaactgaaaaggaaactctaaaaacaaaacctgttttgtaaaaaaatcttgattgaacaaaagcaatcaagtgtttagttgaatgaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcaatatagtgaggagaatgtgttgggaagcacaatcaaagagggtgataatcccgtatctaaaaaccatattgtggtactaagctaacgagaagtagggcgggacacgtgatatcctgtttgaagaaggggggcccatcctccaaggctaaatactcctgattgaccgatagtgaaccagtactgtgaaggaaaggcgaaaagaaccccggtgaggggagtgaaatagaacctgaaaccttgtacgtacaagcagtgggagcgagggcaaccttgtgactgcgtaccttttgtataatgggtcagcgacttatattttgtagcgaggttaaccgaataggggagccgaagggaaaccgagtcttaactgggcgaatagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctagggggccatcccggcttaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcagaatttattctgttgggtaggggagcgttgtgtaagcggaagaaggttcatcgagaggtgggctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtaagggctagcccctgaaggttgaaccggtcgaagataccagctggctgcaactgtttattaaaaacacagcactctgcaaacacgaaagtggacgtatagggtgtgatgcctgcccggtgctggaaggttaattgatggtgtcatcgaaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgtaggatgattgattggggctgctcctagtacgagaggaccggagtggacgcatcactggtgttccggttgtgtcgccagacgcattgccgggtagctaaatgcggaagagataagtgctgaaagcatctaagcacgaaacttgccaagagatgagtcatccctgactttaagtcagtaagggttgttgtagactacgacgtagataggttgggtgtgtaagtgatgtgagtcattgagctaaccaatactaattgcccgagaggcttaactatacaacgctcaagtgtttttgggagctaagtgaagtaagagatgaaaagcgaagcaaataaaagcagagcgaaagagaagtaaaagactaaacaaagaaaagtaaatatagaagacttaatagaaagaaaatcggattcagcttgtgaccaataagaacgagtgaaaggtagaggaaagactgagtaacgagagataaaagagacgagagataaaagagaaaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttaccaaatacttatctaagttaaataaaaacagaaggaccccgtgtcgaaagatatggggttttagcttttgggaatttattcattatttaatcaaataagtgtctaattttaattttcaataagtaagtaatttttcaactcatatgaagtcacattcctataaatgttttattagctgtgctataatcccactaaaattctacccttaaaaacaagagaaattatgaccgcacttaatgtattaatttatcctgatgatcacttaaaggttgtctgtgagcctgttactaaagttaatgatgcaattcgtaaaattgttgatgatatgtttgatacgatgtatcaagagaaaggtattggtttagctgcacctcaggtggatattttgcaacgtattattactattgatgttgaaggcgataaacagaatcagtttgttttgattaaccctgaaattttggcttcagaaggcgaaacgggaattgaagaggggtgtttatccattccagggttccgtgcgttggttcctcgtaaagaaaaagtgacagtgagagcgttagatcgtgatggtaaagaatttactttagatgctgatggtttgcttgcgatctgtattcaacacgagatcgatcatcttaatggaattttatttgttgattacctttctccacttaaacgccagcgcattaaagaaaagttgattaaatacaagaagcagattgcgaaaagctaaaacgtagggtgggctttagccagcaatcatttcaaaaaacggtgggcttaagcccaccctacttcctatcaattaccataacgtagaacattatgaaatcacttaatattatttttgctggtacgccagattttgctgcacagcatttacaagccattctaaattctcaacataatgtgatcgctgtttatactcaacctgataaaccagctggtcgcggtaagaaattgcaagcaagtcctgtaaagcaacttgctgagcaaaataacattcccgtttatcaacctaaatccttacgtaaagaagaagcacagtctgaattaaaagcgttaaatgcagatgtaatggttgttgtggcttatggattaattttaccgaaagctgtattagatgccccccgtttgggttgtttgaatgtgcatggttctattcttccacgttggcgaggtgcagcaccaattcagcgttcaatttgggctggcgatgtacaaacgggtgtaaccattatgcaaatggatgaaggtttagatacaggcgatatgttacataaagtctattgtgatattttaccgactgaaacttcaacgagtctttataacaaactggcagagcttgctccatcagcattaatcgatgttttagataatcttgaaaacggtaaatttatagcggaaaaacaagatggcagccaaagtaattatgcagaaaaactttctaaagaagaggcgcaattaaattggtcactttctgcaatgcaacttgagcgtaatatccgcgcttttaatccttggccaattgcctatttttcaacagaagacaaggatggcaatgcacacactttaaaagtgtatcaagcgaaagtgttgcctcatcaagataaaccagcgggaactattttaagtgcggataaaaatggcattcaaattgcgactgtcgatggcgtcttaaacttattgcaattacaatctgcaggtaaaaagcctatgtctgcacaagatttattaaatggccgtgcagaatggtttactattggtaaggtgcttgcataatgaaaaaattctcttctaaaactatcaaagcaaaaaattcagtaaaaatgaccgcactttcgaccagggctattgctgcaaacttaattttgcaagtattggatgagggcaaatcattgtcagcgttaattccagaagtgcaactttctgtaaaagctcaagatttgcctttactacaagaaatttgttttggcgtgtgtcgagtattgcctcgcttagagcaaattatcaaacgtcttgtggataagccgcttaaaggtaaaactcgcattgttcattgcctgttacttgtagggttataccaattgctttatatgcgagtgcctgctcatgcggcagttgatgaggttgtgaacgcaacaaaatcattaaaatctgatagttttagaggattagtgaatgcggttttgcgtagatttttacgtgaacaagatgaaattttggcaattatcgataaaaattggcaaacgcttcaccctgaatggttcgtgaataaattaaaaaaagcctatccgaattggcgtgagatcattgaggcgaacaatcagaaaccaccaatgtggctacgtgtgaattcacaaaaaaacgccctcgaaacttaccgcactttacttgaagaacaaggtgtttcttcgaaaacaagccatcatcctaatgcgctatgtttagatataccgattgcggtgcaaaaattaccacactttgaagaaggggcggttacggtgcaagatttgagtgctcaatgggcggcaacgttgcttgagccaaaaaatgaggagtggatcctcgatgcttgcgcggcaccaggcggtaagacgacccatattttagaactggcacctcaagctaatgtgattgcattagatgtagaatctcatcgcttaaaacgagtagaagaaaatcttgaacgtttaaatcagcaagcgatagtggtgtgtggtgatgcgagtaaacctgacgaatggttagctgaaatcggtaaaagtgcggcgaaatttgaccgaattttacttgatgcgccttgttctgcaacgggggtgattcgccgccaccctgatataaaatggttacgcaaagaaaccgatatcgctcagctcgttgaattacagaagaaaattttgagtgcactttgggaaaaactgaagccaaacggtgttttgctttatgcgacttgttctgtattgccagaagaaaattgcgaacaaatccaagcatttttaaatgctcacgcagatgcggagttattgtcattgccctttagtgatgataaaagtgcggtgggttttcaatttattccgcaaccaaatagtggcgatgggttctattatgcgaaattgcttaaacgagcatcataaaggagggtgataatgaaaattatcattttgggtgcaggtcaggtaggaacgacgcttgcagaaaacttagtcagtgaagataacgatattaccttagtggataatgaatctcctcagttacaaacattgcaagaaaagcacgatttgcgtgtggtacaaggctctccatcatctccaaaagtgcttcgtgacgcaggcgcggcagatgccgatttaatggttgctgtgacagcctctgatgaaatcaatatggtcgcctgccaaatgggctatacattatttaatacgccaacgcgaattgcacgtatccgtaattcagaatatttacgtgaaaaagacaagttgttcaacaatgaaaatattcctattgatcatttaatttcgcctgaaaatcttgtaactgatgaaattacacgtttaattgcttatccaggcgcattacaagttgcccattttgccaataatcgtattagtattgttgtagtgaaagcttattatgggggggctttggttggatatgcactttccgcatttcgcgaacatatgccacatattgattgtcgcattatgtctattttacgtaatggcaaaccgattcgtccacaaggctcataccattgtagaagctggcgatgaaatcacgtttatttgcgctactgaacatattaaggcgataatgggagagttacaacgtttggagaaaccttataagcgagtaatgattgttggtggaggaaatgttgcttttggcgtagcaaaacgtttggaaaattcttgtactgtaaagcttattgaacgagattcaaacagagcgcaagccttagcagaaaagttgccaaaaacgttagtatttaatggagatgcctcagaccaaaacttgctttttgaagaacatattgaaagtgtggatgtatttctttcattaagtagcgacgatgaagcgaatattatgtcagctttgttagccaagcgtttaggtgcgaaaaaagcaatggtactgattcaacggattgcttatattaatcttattcagggaggcacgattgatattgcggtttctccacaacaagtaacgatttctgctttgttaggtcacgtgcgtaaaggcgatgtaaaaaatgtggcaacattacgacatggcattgccgaagccattgaaattgttgcacacggtaatgtgaatacttcaaatatagtagggcgaaaaattggtgagttgcgtttgccgatgggaatcattattggtgctttattacgagggaatgatgtaattattgctcgtcgtcaagtgattattgaagaaggcgatcatatagtgatttatttaagtgataagaaaaatgtgccagaaattgagaaattattccaaccaagcgcattctttatttagtttttttacttttcagagtgatttattataatagtcgctctttttatgtaatttttgaaggggaacattattatgaattttattaaagaatttcgcgaatttgcaatgcgtggcaatgtcgtagatatggctgtcggtgtgattattggtagcgcatttggcaagatcgtaagttcacttgttagtgatatttttacgcccgtgttggggattttaactggtggtattgatttcaaagatatgaaatttgtattagcacaagcacaaggcgatgttcctgcagttacgttaaattatggtttgtttattcaaaatgtgattgattttattattattgcttttgcaatctttatgatgatcaaagtaatcaataaggtaagaaaaccagaggagaaaaaaactgcaccaaaggcagaaacattgcttactgaaatccgtgatttattaaagaataaataatatttaaagaatgaaagttagcagaaatgctgactttttttattactattttttaagctataatcagccctcaattttagggaaataaaatgaaaaaatataataaacttcgcattgaatgggattgtcgccgaggaatgttagagttagataaaatcataatgcctttttatttgacgcattttcatgaattaacggatgacaaaaaagatatctttattcgtttattagcaagtacggatttgcagttattttcgtggttttttaatcttgcgaaatcacaagatgtagagcttcaaatgatggttgaatatattcaaaaagtgcagaaaatcatcataaattaaaattattgattagcgaatgaacttttttaacacgcttttgtctgaacaagcaacaagagcttgctgtcttgatattaaggcgtgttagatattggcatgggagaaatatggctgaacagctaacagatcaggctttggtagaaagagtacagcaaggggataaaaaagccttcaatttgttggtttcgcgttatcaaaataaagtagcagggcttttgacccgatatgtatcgcgtaacgatattcctgatgtggtgcaagaatcctttataaaggcttatcgctcaattgaatcttttcgtggcgaaagtgctttctatacatggctttatcgaattgccgttaatacggcaaaaaattatttaacggctcaaggtcgccgtccaccaaatgaagatattttggcagaagatgctgaaaattatgatgtgggaacacaccttagggatgtggatacacccgaaaatgagatgttgtctagtgagttagaaagaattgtttttgatactattcataacttaccagaagatttaaaaactgcgattacgttacgagaactagaaggtttaagttacgaagatattgcagaaattatggattgtcctgttggtacggttcgttcccgaatcttccgagcaagggaaatgatcgaaaataaaattcaacctctaatgtagagcgaataacaatcggagtttactatgcaaaaagagcagctttcagcctatatggatggagaacaagtcgaaactgacttgatagatgctttattaagagacgaagaattacaagcgtcttggcattcatttcataccgttcgttcagtaatgcgtaaagaaagtgcggtctttttaggggctgattttaccgctaaaatggcagatttgattgagttagaagacgtgaagaaagttgatgtcattgctgtgtctcaacctgaaccagaagacgcacataattctgtatttatgcaaaaattaaaagcgttctttgcaccaatgacgcaagttgctgttgctgctggtgtatgtttagtggcagtacttggtgttcaatctttcaataataaaaacgatgcgtctaatttacctgagactccagtattgcaaaccttgccatttaataatgcggttcaagaggttagctataatgcgccaagtaaagatacattaacttcagatcagcttgagaaaaaaagtcgtcgcattggtgcaatgttgcaaaattatgaattgcaacgtcgaatgcactctgatgctttagatgtaagtagcagtcaagtaagataaattggtttcctttgttcagattattgattcaccacctaattgttatttagtgtggtgaatttttatcctttagatttctatgaaaaaaatcccattaaaatttaccgcactttctctttctttgctattaagtagcattgcttctgctgaagagctttctgcgaagcagtctttagataaaatgacacaagcattggataatctcaattatgaaattgcctttgtgcaaactactccagcaaatatggattcatttcgttatcgacatatcaaacaagataacaaaacctacgcacaattagttactttagatggtcgccagcaagaaattattcaacgtgataatttagtcagttattttcagccaaatgctcaagcatttacgcttaatagtggcaatatagttgatgcgatgcctgcggttgtgcgtgcaaattttgataagctttcttctgattatgatttcgtaaaattaggtaaagatcgcgttgctgggcgtttcgctgatacgattagaattgttcctaaagatgattttcggtatcaatatttggtgtttatcgatgaagaaaatggcttgttattacgcagtgatatgcttgatcgcgaaggcaagctacttgatcaatttagagttgtaacactttacatcgatgacagattgagaggattaacggattatattaacaaggtatcattgccccctttattgaaagaaagtaaaaatgaacaaagttcagatataacttggtctgcaggttggttgccacaaggtttttctttaattcgatatactcaagaaatattagaaaatgaaatcatagatagtgcattatatagtgatggcttatttacttttacgttgtttgtctctaatgtaggctctaatgacctaccagaaaatacttggaaacaaggggcttatacgatttatagcgaggtcatcggaggaaaagaaattacttttattgggcaattaccaatctcgacggcaaaacgcattgtacaagaagtcaaatttagataaaaagtgcggtaattttttacgatatttttatcaataactgattttgagttaggcattgactaagattcgcacgtttttacgtgcgaatttttattttcttaattttattaattctacttggtgattatgacctttttttagaattaaatttgctcgctcacgggttggaagaatgttttgattgagatttaatccgttaatttcatcccagattttacttgccgtcgcgatagcctcttcttttgataagcttgcgtaatgtttaaagtaagaattaggatcgttgaatgcactttcgcggaatttcagaaatcgtttgatataccattctttcaataatttttcttcagcatcaacataaatagagaaatccacaaaatctgatacgaatgtttgatcggttttattattacccgtttgaagtacattcaagccttctaaaataagaatgtcaggtttatctaccacatcaaatttatcgggaataatatcgtatgttaaatgagagtaaattggtgctgtaacattgcttttacctgattttacatccgctaaaaagcgaatgagtttaggtgtgtcataagaaacgggaaaacctttcttttgtaaaagattatcttgtttaagcttgtttaatggataaagaaacccatctgttgtgatgagatcaacttttctttcagttggccaatgagaaagtagagattgtagaatacgtgcagaagtgcttttcccaacagcgacactgccagcaatactaattatgtaaggtgttttggcattatttctgcctaaaaaacgatgtagtaccgtttggcgatgtaaattttcatcaatgtaatagttaataagacgagttaatggtaggtaaattgtacttacttcatctaatgaaaggtcttcattaaagcctaagagtggtttgagatcctgttctgtcaattttaatggaacggatttacgtaattccgcccattgttcacgattaaagcttaaaaaaggtgtttgctgagttgaaaattccacaataattttatttgatggctaaataaacagagaaaaatatacgctataaataaaaatttagcattcatttttcattaaatgtacgctaatttgattaaaaaatcacttttttgattgtgatttaaacgaataatcaaaaaaataaacttttttataaaaaatacttgtcagttaaagttttttccatataatacgcctcacttgcttacgacacgccgacttagctcagtaggtagagcaactgacttgtaatcagtaggtcatcagttcgattccgatagtcggcaccattctttcgtatcaagtattcatttagtgtggaggggttcccgagcggccaaagggggcagactgtaaatctgttggctcagccttcgaaggttcgaatccttctccctccaccatcttttagatggatcctgatgggacagacgaatttaggacttgcgggcatcgtataatggctattaccttagccttccaagctaatgatgcgggttcgattcccgctgcccgctccagacgctgatatagctcagttggtagagcgcacccttggtaagggtgaggtcggcggttcaaatccgcctatcagcaccagtcttataattcctcatccttatatcaatcagcaaataaatttattggttaatgtggtttaatttacccatcgataaccgtgtctatttagagggactatttcaatgtctaaagaaaaatttgaacgtacaaaaccgcacgtaaacgtgggtacaatcggccacgttgaccacggtaaaacaactttaacagcagcaatcacaaccgtattggcaaaacattacggtggtgcagcgcgtgcattcgaccaaattgataacgcgccagaagaaaaagcgcgtggtattaccatcaacacttcacacgttgaatacgatacaccgactcgccactatgcacacgtagactgtccgggacacgccgactatgttaaaaatatgattactggtgcggcacaaatggatggtgctattttagtagtagcagcaacagatggtcctatgccgcaaactcgtgaacacatcttattaggtcgccaagtaggtgttccatacatcatcgtattcttaaacaaatgcgacatggtagatgacgaagagttattagaattagtcgaaatggaagttcgtgaacttctatctcaatatgacttcccaggtgacgatacaccaatcgtacgtggttcagcattacaagcgttaaacggcgtagcagaatgggaagaaaaaatccttgagttagcaaaccacttagatacttacatcccagaaccagaacgtgcgattgaccaaccgttccttcttccaatcgaagatgtgttctcaatctcaggtcgtggtactgtagtaacaggtcgtgtagaacgaggtattatccgtacaggtgatgaagtagaaatcgtcggtatcaaagatacagcgaaaactactgtaacgggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtacaatcgaattaccagaaggcgtggaaatggtaatgccaggcgataacatcaagatgacagtaagcttaatccacccaattgcgatggaccaaggtttacgtttcgcaatccgtgaaggtggccgtacagtaggtgcgggcgttgttgcaaaaatcatcaaataattgatggattcctgaatgtcttaaagataaaagacagaagaaacaaaagaaaagtgcggggaaaattctccgcacttttttattttatatatgtaaatatttactaaattatctgattttggattagaactaaatgctcactggtcatctaaatatcctgttgcagtttggtttgtgttacccctaggaatggtattgccggtggtatctttaccccatcactgacaacaggcgcaggcattggcacaatgctttgggatctaagtggtggtatggttgatcaacgttttttggtgattttatgtatggtggcatttttagctggctgcacacaatcgccagttacagccagtgttattgtaatggaaatgacaggtgcacaacccgttctcatttggctcttgatttccagcattattgcatccataatctcgcaccaatttagcccaaaaccattttaccactttgctgcaggctgttttctccagcaaatgcaagctcgccaagccgaagaattacgtagcaaaaccgaacaagagaaataaaaatgcctcaaaatctaccgcacttttaccgcggccgtttttctgttgcaccaatgttagattggacaacacgccattgtcgttattttcatcgccaattttcaaagcacgcattactttacactgaaatggtcacagcaccagcgattatccacgcaaaatacgaccacttggattttgatttacaagaaaatcccgttgcgttacagctgggaggaagcgatcctgaacaactcaaatattgcgcaaaacttgctgaggaacgaggctatcacgaaattaatcttaatgtaggatgcccttctgatcgcgtacaaaatggaatgtttggtgcttgcttaatggcgaaagcagatttggtagcagactgtgtagaacaaatgcaaagtgcggtcaaaattccagtcactgtgaaaacgcgtattggcattgatgaattagacagctatgaatttttatgtgattttattgaaaaggttcaaggaaaaggttgccaagagtttattatccacgcacgaaaagcttggctttcaggcttaagtcccaaagaaaatagagaaattccgccattagattatattcgggtgtatcaactaaaacgtgattttccacatctaactattgcaattaatggtggtataaaaaccattgaagaaatgaagcaacatttgcaatatgtggacggcgtgatggttgggcgagaggcctatcaaaatccaagtttacttgggcaaattgaccaagccttatttgatcctaacgcaccaattgttaccgctcatgaagcggtagagtcaatgcttccttatattgaacaacaacttagccaaggaatacaccttaatcatatcgtccgtcatatattaggcgcattccaaaattgcaaaggtgctcgtcaatggcgacgctatttaagcgaaaatgcgtttaaacaaggcgcaggaattgaagtggttgaaacagccttaagctttgtagaaagctaatcctaaaaacaaaataagccgcaaaagtgcggcttatttttcagctgtttttcttacgcaatacgcatttgaaaaatcaccaattcagcttggcaacagaaagtgaaatctgcctttaataaatagccatcatccacttttgtaatttcagttgttatagggggacataagccgagacctataaataatatcactttgggttttagagataactaaaactcaaactgaacagacattctgtaatttctgccaggtgcgtagaagcggtttaagcctttacctgttgctgtttctactcggttaattgtgccaagatgtcgaacagaacgggcagagtcccaagtgagatattttttgttggttaaattatatacaccagcggtaaatgtaagatttttaattggtttccaataggcaatcgtatcgatcactgtatagcgattattacgccataatccgcgagaatcttttacgtctttgccgtttgcttgtgtagcaggtacagttctttcagtgccataaatattttcttttcgtttgaccatactcgtccattgagaattaaagctatcttttgcttttttggctgcaacatcggtgatatacacatccatgccccattttttgcttggtgcatcatagccaatattgtataccgatgtggttggttgcaatgcattcataggctgatcttgtgaagcaatagcagtatattgcggatttagcttcaaaaattcagcatatccagaacgtaatttgttatctttaattcttcctttttgataggtcaatttataacctaaatggaaaccttgtagtttttcaaacaaatcacccatttcaagacgtgaagcaatttcgatacctctgactcttgcttgatctcgattttggttttgataaaacggatattctattgcagaacctttatcaatttgtttatttttttcaaagaccaaatcaataaaattacgataatcactttgaaatgcacttaacgtaagataactattttccttataaaaggtaaatgcgacttctttcgtttttgctgtttctgcttttaaattggtatttggacctatggaaaaatctggatgcttgaatgtcatataaatttcatcagaggttggtgcacggaaagcattagcatatttaagctgtacacgaagccaatctgtgggatcaagatttaaccctaaattgtaagaatgatgtttatagtcagttttgcgtaataacagggcaagattctcttcaaaattttttttataacactcagtgttatagcgacaatccttatatccgctaggaacatacgcgccataaacgacatctttttcattaaaaggtacaaatattcctgcaattaagccacctggaactggagttttttcatcataaccaggcaaatattttacgtggtcatagcgataatttaaatctagccctagccaagaggtaagttgcacattatctccaaaatacaacacattatttttagtggtaacagggattaaataggtatctttgcctatgtcggaatgaagcggtgtaccattgacacaaccagctacgctgacattagggtgtggtgttttcttctcgccaagatttcccccctttgctctagcgcagaaaaagtagtcagcccaccattgcacattggctgcggtgttgtattggtgattaaccatactttttagtgttttttcataaagaccaccatattttagttggtgttgggtatgccataggtgaaattctttgtctaaatcaagtttaatttgttgggtatgggtgtttaaatcacggtcattaacgaagtctgtgctgtagccatagctttttggaaagagaaaacgagctgtttcttgtggaaagccattccacgacggtgtctttcccttttttagtgggattttgccatattttttcccgttaggtaatgttccaacttctatttctctatcatcataagtgtatttttcactggagttttcatcgtattcttgataaattctaaattttttactacaatctaatttttcacaattaattaaaacagaatcaagtgaactgcgttgtgaaatatccttatcagcatcttcacccttactattcttaaattcatgagaccagccaatttctttgctttcaagttcacctccatatttatccttaattttataaacccctttttcttctactaaatgcaatccttgggggttacttacaccattacaagtggattgatgacaatattcatcagaacgtgctttattggtgattttttgtgaagaataacttagtttaatatgatcccaaaaaggcgtttgactgaaattttcataactaaattgaatattttttcgtttggattgatcgttaataatacgctcaccgtatttttcattgttagctgtactatatggtctaagagcgtaagacaaatctataccctttgtttctaaagtagaatcatctaatgccacactcaagcgatggttttcattaggctgaaagcccagttttattaatgtgctttggcgggtaatttgataaggatcggctttttcacgggtaggaccaaccgctcttaaatccgcctgtttattgggataaattttataatcgtagttttctatttcgtgcccatcacgcgttgtatcaatgattaaaatatcaaattttttagaacgtcctgctaatgtaagtgtcttaaggttttgattattcattgtttgatagccacgtttataggaaagataataatctttatctatcagataatctcgagcatctttagtttcaaatataacagagccacccaatgcgccactaccagattttaaggagtcagcacctttggtaatagttgctgttttaacattttcaatttcaatgctattacgagtattattaaaattgccatagccttcaaatagttctttaaatccttgagagcttaaagtttcagcttgacgaagcccatcaaccataatacctacacggttttcatcaacccctcgaactgcataaccacttgcgcccgttctacctgtttcaaccaccgtaatacctgtttcatagcgaacgagatcacgagaatcagacgcctgctgtttcgctaattttttggcagaaatttgggtttccccgacttttttctctttgacattaatattttctgatgaacctgaaacattaatttgttctagttgttcagaaacattactattttggttggttggttggttggttggttggttggttggttggttggttggttggttggttggttggttggttggttggttggttgggcagcataggctatgcttgcatttaatgcaaatgcaatagagcaagcaagcaggctgaatttaaagttggtcataggtttccttattcttaatgataataattgtcatatattaaataattcaatttatctaatcaatatcaaaatgaaaaagtaattgtagggtgggctttagccacaacaaacaatcgtaagatattttggtgggctgaagcccaccctacggaaagtacgcattgattacgtacttctttttaggagtaatcattatgatgattttatgaattgcgtagtgttattgatttagtaattgtagggtggctttagcccaccaacaaacaatcgcgagatattttgtggctaaagcccaccctacgtttgggataggttcaaaataagccgcaaaagtgcggcttatttttcagctgtttttcttatgcaatacgcatttgnaaaatcaccaattcagcttggcaacagaaagtgaaatctgcctttaataaatagccatcatccacttttgtaatttcagattgaatttcacaaggttcactttctacatcacgtgctttctgagtaaaaaatgcgagtgcttcttgcgcttgtccttcactgtcataaatatattcaataacctgactacaatcacgattatcgaaaagtgatttcatatcaaaagtattacaacctacacattcaatcggtttttcggtttgaattgccataatattatccttttattcagattattttgcagcgacaaaacccactgcttcatacactttcgccaaggtttcttgtgcttttgcacgagctttttccgcaccttgtcgtaagatattatctaataaagtttcatcattacgatattgatggaaacgttcttgtaaactagcaagtagggttgagacttcatccgctactgcagtttttaaatgtccgtacattttaccttcaaattctttttcaagatcagcaattggcttatccgtaaccgcagaaagaatatctaaaagattagatacccccgctttattttgcacatcataacgaacaacaggcggctcatctgaatctgttacggcacgtttaattttcttcgccacagattttggatcttctaaaagtgtcaccacgttgttgcggttatcatctgattttgacattttcttttcaggatcttgcaatgacataatacgcgcacctgcttttccaatgaaaatttcaggaatggtgaaaatattgccataaagtgcattaaagcggtttgcaatatcacgcgtaatttctaagtgttgtttttggtcatcgccaacaggcacgctttttgcttgataaagtaaaatatccgccgccattaacacagggtaatcaaacaaacccacgttaatattttctgcataacgcgctgatttatctttaaattgcgtcattcggctcatttcaccgaaataggtgtaacagtttaacacccagcttaattgcgtgtgttctggaacgtgagattgaacaaaaatagtacttttatttggatcaattccgcacgctaaataaagtgcaagcacatcaagggttgctttgcgaagggcaacaggatcttgacgaacagtgatcgcatgtaaatcaactacgcaaaaaatacattcataatcttcttgcattttcacccagttacgcaacgctcccaaataatttccgatagttaattcaccagaaggctgcacgccactaaaaacaattggttttgccataatcaatccttaataccttaaaactgttcacacatcatatcagaaactctaggcttttttaatgttcgagttcaaaagctaggttaaaaatgctatatttaacggaaacgttttcctgatatttactaatgaaaaactaccacgatattgttcttgcccttgctggcgtgtgccaatcagcaaaattggttcatcaacttgcaacagaaagtcgagcagattcagagacatttttaaccgcacttaatagccttttcattacccagcctcaacgaattgaagatgtttttggtggcgaagttcgtcatttaaaattaggtctagaaaccttaattcatcagctcaacgcgcaaggcgatcaaaatttaactcgctattggctaagccttttagcattagaaggaaaattatcgaaaaattccgatgccaaacaaacattgggcaatcgaatttctcgcctaaaagaacaagaaattcattacgctcgtgatagtgaaacaatgctatctattatggcaaatatttacagcgatattattagcccattgggcaaaaaaattcacatactaggctcgcctgattatttgcgacaagaactcgtgcaaaataaaatccgtgcagttttacttgcaggcattcgctctgccgtgctgtggaaacaaatgggcggaacaaaatggcaaattttatttttccgcagaaaattacttgccaccgcaaaacagatttattcttctatttattaatacaattctggagcaaacatttatgcaactctctacactgaccgcactttcccctcttgatggtcgttatcaagataaagtaacgccattacgtgctatttttagcgaattcgggttaatgaaattccgtgtagctgtggaagttcgttggttacaaaaattagcttcaacggcagacattaccgaagtaccgccattttctacgcaagcaaatgcttttttagatggaattgtggctaattttaatgaggccgatgctgcgcgtattaaagaaattgaacgcacaactaatcacgatgtgaaagccgttgagtattttctgaaagagaaaattcaaaacgaagtggaactagtgaaggtttctgaatttattcacttcgcttgcacctcagaagatattaacaatctctctcacgcattaatgttaagcaccgctcgtgacgaagtgattttaccagaatggcaaaaactgattgatgaaattactcgtcttgcagaagaatataaaacgattccattactttctcgcacacatggccagccagcttcaccaagcaccgtgggcaaagaaatggcgaatgtcgtttaccgcctaaaacgtcaatttaaacaactccaaaatgcggaaatcttaggtaaaatcaatggtgcagtaggtaactacaatgcgcatttatcggcatatcctaatattgattggcataaattcagcgaagaatttgtcacttcattaggtattcaatggaatccttataccacacaaattgagccgcacgattacatcactgaattttttgatgctgtagttcgctttaataccattatcattgattttgatcgtgatttatggggatacattgcattaaatcactttaaacaacgaacgattgcaggcgaaattggttcttctaccatgccacacaaagtcaatccaattgattttgaaaactcagaaggcaatctaggattagccaatgcagtgatgacccatttaggtcaaaaattaccaatttctcgctggcagcgtgacttaacagattcaactgtattacgtaatttaggcgtaggattaggttattgtttgatcgcttatgcttcaacacgcaaaggcatcagtaaacttgaagtaaatcaaccgcacttattagaagaactcaatcaaaactgggaagttttggctgaaccaattcaaaccgtaatgcgccgctatggaatagaaaaaccttacgaaaaattaaaagaattaacgcgaggtaaacgagtgacagaacaggctatgcgtgaatttattgataagttggatattccacaagaagaaaaattacgtttacaaaaattaacacctgctacttatattggggctgcagtggaattagtagaaaaactatcataggaatttggctcttttttcaacaatattctttacaagaacatagcttttctctataatcctgcgcctgtgttagtcaatctaacaaatttctggttggtgcttgacctattcaagccccatccaagaccgtaggggagtaatcttaattatcctacgtagatggtgaacagaataagaatttttcttgcttctgggcgccgaagtcatcctagtcttaggattaggtaaattaattccgagtaatcggagtgtattcaggagctaaaagccaatggcattaaatcttcaagacaaacaagcaattgttgctgaagtaaatgaagcagccaaaggtgcactttcagcagtaatcgcggattctcgcggtgtaactgttgagaaaatgactgaattacgtaaatcagcacgtgaagctggtgttacaatgcgtgtagttcgtaatactttattacgtcgcgcagttgaaggcacagattacgaatgcttaaaagatacgtttgtaggtccaacacttatcgcgttctctaacgaacacccgggcgcasstgctcgtttgttcaaagagtttgctaaagcaaacgataagtttgaaattaaaggtgcagcctttgaaggtaaaatccaagatgttgaattcttggcaacattaccaacttacgaagaagcgattgcacgtttaatgggcacaatgaaagaagctgcagcaggcaaacttgctcgcaccttcgcggcattacgcgacaaattacaagaagcagcttaattattaagcgtttcttacttcatctaactttatttattttaggaattgattgttatgtcattaactaacgaacaaatcattgaagcgattgcttcaaaaactgtaactgaaatcgttgaattaatcgcagcgatggaagaaaaattcggtgtttcagcagcggcagcagtagcagcagctccagcagcaggcggtgcagcggcagcagaagaaaaaactgaattcgacgttgtacttaaatctgcaggtgcgaacaaagtagcagtaattaaagcagtacgtggtgcaactggtttaggcttaaaagaagctaaagatttagttgaatctgctccagctaacttaaaagaaggcgtttctaaagaagaagctgaagcacttaagaaagaattagaagaagcgggtgcagaagtagaagttaaataatttctattttaaccactttaaaattcaaaaaaccgatgggaaaccatcggttttttcttatataaaagtttgttatagtttttacttaaaaacttaccatttgctatctttctaagatagaatattacccgttgttattgatgaataaagagaaaatttatgacaaaaaaagcattaagtgcggtaattttagcagctggaaaaggaacgcgtatgtattctgatttacccaaagttctacatacaatcgcgggtaaaccaatggtaaaacacgtgattgatactgcccatcaattaggctcagaaaatattcatttaatctatggtcacggtggggacttaatgcgtacccatcttgcgaatgaacaagtaaattgggtattacaaacagaacaacttggcacagcacatgcagttcaacaagcagcacctttctttaaagataacgaaaacattgttgtgctttacggcgatgcaccattaattactaaagaaacattagaaaaattaattgaagcgaaaccagaaaatggcattgcattgcttaccgtaaatttagataacccaacaggctatggacgaattatccgtgaaaatgggaacgttgtagccattgtagaacaaaaagatgcgaatgctgagcaactaaatattaaagaagtcaatactggcgttatggtatctgatggtgcaagtttcaaaaaatggctagctcgtgtaggcaataataatgctcaaggcgaatattacttaacggatcttattgctctcgcaaaccaagataattgtcaagttgttgctgtacaagcaacagatgtcatggaagttgaaggcgcaaataatcgcttacaattagccgcacttgaacgttatttccaaaataaacaagcctccaaattattacttgaaggcgtaatgatctacgatcccgctcgttttgacctacgtggaacattagagcatggaaaagatgtggaaatcgatgttaatgttattatcgaaggtaatgttaaactcggtgatcgcgtaaaaattggcacaggttgcgtattgaaaaatgttgttattggcaatgatgtagaaataaaaccctattcagtgctagaggattctatagtaggagaaaaagccgcaattggcccattttctcgtttacgcccaggtgcagaacttgcagctgaaacgcatgtcggtaactttgtagaaattaaaaaatctaccgttggtaaaggttctaaagtaaatcacctgacctatgttggcgattcagaaattggctcaaattgtaatattggagcgggtgtcataacctgcaactacgatggtgcaaataaatttaaaacgatcatcggtgatgatgtgtttgtgggatctgatacacaattagtcgcgccagtgaaagtcgcaaatggcgcaactattggtgctgggactacaattacacgtgatgttggcgaaaatgaattagtgattacaagagttgctcaacgacatattcaaggttggcaacgaccaataaagaaaaaataaaatagaataaaaaatcctacgtattatcgtaggtttttttataaaccaattttacaaatcgtaattaaaatcacataaaaaatgaccgcacttaatgttaataatttatttgctagtttaggtttatgttgatgaagacggtatagcattctagctgtaacagctagaataaagggataaacccaaaaaagcgttgaaaataaattgatttgccagcttgatagatagggatttttactaaatgctgtagaaattaataatgccattggacacaataatataggcgaacaaaaggcagcaagaccccaagcaaatggactaaatttagttggtaaagattgttttttcatattttaaataattaaaaataaatagatacaagaaagaaatataataaatatgttgaatagtaaagaatattttaatgaaagtaacaatgtagaaatggcgcacccgaaaggattcgaacctttgaccgctcggttcgtagccgagtactctatccagctgagctacgggtgcgtagatgatgctttaattattcataaccactttaataagatagagccgttttaaaaatggcgcacccgagaggattcgaacctctgaccgctcggttcgtagccgagtactctatccagctgagctacgggtgcagaataaataaaacaaacaatggcggtgagagagggattcgaaccctcgatggagctttttaaccccatactcccttagcaggggagcgccttcagcctgctcggccatctcaccacaatcagtgtgagcggtataatacgttttttagaaaatatgtcaaaccattttttgaaaaacacacctgtttgaatattttatctacacattaaatatattattgaataaaaatctactcatcattcaaaaatactaaaatcttagatattgtttcccgtcttaattcatcttgctcaaataacacctcatgtttagaatttagtgctgttaatgccccttcgttctattattaaaagaagaaccgcactttttgaagtgcggttatatttttaatagttttacgccacctgtttaggttgtttaaataccgtaacttctggtgctacgcctataaatttctcaatctgaacgatacaagtatttggtgaattgccttgtgccaatttagatgtaccttcatctcgagttaacacatttgcacaaccatttttacataatggtttttcactttcacctaagtacattgggtcataccatgcgccttcatggagagcgacagtacctttgatgatattttctgttacagccgcacctgcaagcacttgaccgcgtttgctatgaatgcgaacaatatcaccgtctttaataccacgagcagccgcatcttcagggtgaatcatcactggctcacgatcatttaccgcatatttttgacgtaatgaagtatgcgccaattgactgtgtaaacgatagtaaggatgtggtgtcactaaagctaacggatattcttccgtcacattacccgcaaactcttcaggttccatccaactaggatgccctttacaatcgttataattcattttctcaacaacatcagagaaaatttcaattttacctgacggtgtgccaagcggattgagcaatggntcttcacggaattcaccataacgcacccatttcttcgcagcttcacccgcctcaaaacttaatggtttattttctgcccagaatttgtcaaaacgtggcattgctacacgatttgcacgtgcagcactaaaggctgcattatagaattcttccagccactccatttcagttttaccttcagtgtattgttcttccacaccggcacgtttagcaagctcaacgaaaatatcgtagtcattttttgcttcaaattgtggtggaaccacttgtttcatcgggtaaacactcatcatagagtagtcgccagccatggttaagtcattacgttcataactcgtcgtagctggtaacacaatatctgccatgcgtgcagttggcgtccagttcacctcattgacaatcactacatcaggtttctggaaagctttcactaaggtattggtatcttgatggtgaacaaacgggttaccacctgcccaatataccgctttgatgtcaggataagtaatttcagtaccgttatactgaatctttttgcctggatggagtaacacatcagcaatacgcgctaatgggaacgcggatttagacgtatcatccaaccatgtttttgcccccgctttgcctgatggacttgctgtaattgagccgataataccgcctgtcgccgttggtaccccaccatttgaataatgataactcaagccaaagccgccacccggtaacccaatttgtcctaacatagatgcaagggttactaacatccagtgggtttgttcaccatggcgttggcgttgcatcccccagccacccattaacatggtacgtttactggcgaaatcagctgcaagttgcttaatggtttctgctggcacaccacaaattttagctgcccattccgctgtttttggttggccatcagttttacctaataaatattcttcgaatttagcgtaacctgacgtatattttttcaagaaatctttatcgtgcttgccttgttcaactaaagtatgtgcaataccaagcattaatggcacatccgttgctgtattcactggaatccattctgcattcaacatttggcaagtttcgcttttttgtgggtcgatacaaataatacgtttaccactcgcttggaatttcttgaaatattcaatccctttttggtcagtggacatccaagcaatacgcattgttgtgagtggatttgcagaccaaagcacaataatatcactactttctaatatggattcccagctggtttgttgttcgtacacctcaatcgtgcctaatacatgtggcataattacttgtgcagcccccgtagagtaatcccctttgtgtcccacaaaaccacctgtagcgttcatataacgctgtaataacgtacgagaagcatgtaatgaaccacaactaaaccaaccataagaaccggcaaaaatacctgttgatccatgttcgtcacgcacacgtttaagctgattgtgtactaaatctaacgcttcatcccaagaaacgcgcacccattcatcacgaccacgcattgtagtatcgctttttcctggattagctaaaaagcctttacgcaccattgggcatttcacgcgacgttcgctatacaattgatcggcaacaactgtttgcaattcgttcggcactgcaggctcaatagctggaccagatttcacgaccttaccatcttgtactacaaccccaatagatccccagtgagcggcagtcactaccgttttcatttcagcttcttttgcgaccgcactttttgatacaacgcccaccataccaccagaaagggcactaccagccacgcctaaagatgtttttttcagaaaatcacgacgttgttcatttacgttattctttttcatttcagcctcgttttagatagttaattcattcattattgttttgccatatctttggcattgcgttgcagataaatagttaatgcacgtacttcatcttttttcattgatgtacggtctttcatagaattcaccacaccaatccattggttagccgtgtaatgatctgcaccaattgctgcgtgacaaccactacattgagtttggtttaactgattaccgtattgattaagcgtggttaaatctgatgtcattttttcttttgcgacattcaccgcaacactgatttctttccaatcagaatctgttactgcatcatgaactatttttaatacttgaacatgattacgtgcatcttcgtccattaaagcaagcgtgatacgtttacctaattcttgatacacaactgcttcagcccccacttgttgccaaccatgtaaagtgccttgaatttgatcaccatccactttccattgcattaattctgcataaggcattaggcgaacctcatttcctttatcattggtcgcttttaccatttcagtggcaaaaatagctgagccatcagagagagtaccaccttgtactgcagaggatttttgtgtattttgatcgccatgcacttcaggtaggaagtgaacaatgcccttgtgacaatcaatacaagtttgaccgtttgtttgcgcctccgtatgagtttgttttgctaatttagtttgttttgaaagctccattgcatcaaaactgtgacagctacgacaggtttctgaatcattggctttcatatccttccacactcgttgtgccatttctgcacgatgagcttcatatttttctttattctcaatcttaccttgtgcttcataccacaagtcttttaaagcaataaatttagccttgacataatgccaaccttcttttggaatatgacaatctgaacattgtgctctaaccccttttgcattagcaaaatggctagaaccttcccactcctgttgtggataactcattgaatgacaactagcacaaaactctggtgtactcgttttgtgcattatccactgagaaccccataatgctcccaccccgacaccgactaaacaaagtgcggttactatttttttcatttttgacatagccactccaataaaataataaaaaacaaccctaactacttatagttagggttgattgtagaggttttgtaaatcaaaaactatgatatttctcaagaaaaaatgttataagctgaagaaaaacactatataaatcaataaataacgattagtatcaactttgcacatttagaaaatgattaacacttttaagtacatttcttcgaacattatctttttcaaataacacctcatgtttagcatttaatatgacttcacatctagcattcggaaaaagtgcggttaatttttcaagatttttgttatctactatttttctttttcggcttgtaaaattaggattggaatttcaatcttaggaataactttcggcaagcgtttaattgcgttcaaacacaaatgtacccaacggaatgttggcccgccaagattaattgctggatttttacgatttatacgattcatccatttcattctggttttacagaaagttaattcattgtattccaagtgggcttgttgataagcacctttgccaaaaacataacgctcgccttgtcctaaaatattcattagggtaataatcagttcatctctaatgggatgttttaaaagaataccgtaaaaaggcgaagaaagtaccgctttattaatgtgatgatcataatttgccaaataataggttgcaatcaatgcgcccattgaatgagcaagcaaatgctgcgttgaatagctgaaaagtgcggttactttttcgatgattttcgccatatcatcgacatagaaacgaaattcatctaaatgccctttttgaggaataatacgctgtgaatagccttgaccgcgatgatcaaatagcaatacatcgtaaccttgatgataaaaatcataagcgagctctgaccatttcagcatattttctgctcgaccatttactaaaatcatcaattttctgaccgcactttcaggttgaatcaaatgacgataagctaattttatatttcgtttaccagaaagatattgggtaggaaattgctcaaaaaaaggcaataattctgcaagagcaaattgatgaaaataaggttctctgatcataattttttaatgaaaagggcgtagtaaatacgccctttgtagtgaaagtaaaatttatgccactaattgttttaaaatacggcgaactggctctgccgcaccccataataattggtcgcccacggtaaaagctgccaaatattcaggccccatagccaatttacgtaaacgccccactggcacgcttaatgtacctgttactttcgctggcgttaattcacgcaatgtgatttctttgtcgtttggaatcacttttacccattcattatgtgatgcaataatttgttcgatttcttctaatggtaagtcttttttcagtttgatggtaaacgcttggctatggcaacgtaatgcaccgatacgcacacataaaccatcaacaggaattggattgtcgcttaaacctaaaattttattggtttctgcataacctttccattcttctttagtttgccctgtttcaggaagaagtttgtcaatccaagggattaagctaccacctaatgccgcgccaaagttatccgttgggaaattatcagcacgcatttttgcagtcactttacgttcaatatctaaaatagatgaagcagggtcttttaattcactcgaaactgcttgttctaataaacccatttgtgaaagtaattcacgcatattttttgcgccagcacctgaagccgcttgataagttgccacagaaatccattccaccaaatctttttcaaatagaccgccgatagccattaacattaagcttacggtacagttaccgcccacgaaagttttaatgccttttttcaaaccttcagaaatcacgtgttggtttactggatcaagcacgataattgcatcatctttcatacgcaacgcagaagcggcatcaacccaataaccatcccaacctgttgcttttaattttggatagacttcattggtgtaatcgccaccttggcaagtcacgataatgtctaattttttaagttcttcaatatcgaatgcacttttcaggtcgcctgcatccttgccaccaaaaacaggtgctttttgacctgcttgtgaagttgtaaaaaatacgggattaagattttcaaaatcattttcctgcgacatacgatccattaatacggaacccaccattccgcgccagccgataaagcctacatttttcattgttgtttccttagtttgttgtgcttgaatagcattattaattacaagatagcgttagnaaaatcaagtatttttaatgaaaattgatctttcgcgaaagaaattaaataaaaaagtgtggttaatttaaaagaaaatttaatttaatcactctttttctagttatctacttcaacacttattacgccatcttctgctttaagtaaagcatacgcatctttcaacattgtggaatcaatggaaaagcaacgaatttgtaaccgcacttctccactactttgatctttgacttgtatatgttcaatacgatactgattatttactaacaattgggtaactttccctatgctttccgcatcattgacaagaatattgaatttcgtccgacgacgttgtgatttacgatgaacccaacgttgaaccaacggacttaatcgaatagacaccaaaatcatcacagtggcgatgaccgcatcaaacacgaaacccgccccagcagcaataccgatccccgcagaagcccaaataatcgccgcagtggttaaacctgaaatcgcatcatttttcttatgcaaaatcacaccagcacctaaaaaaccgatgccactaatcacttgagccgcaagacgcattggatctgtacgaatattttctgaaacttgtgcataatgctctgcggcttgaattgaaacaatggttagcacacaagtggtaacggcaataatggcacaagtttttacacccacaggcttacgtttaagttcacgttctaagccaataacactgccaagcaccatcgctaatagcattttgctaaaaataattaagtgatcaggattgaaaagtgcggttaaaagtaaagatgaattttccataatgataaaaataagtccgacatactcgtctattctacatcacttagcttaaaatctttacctttccaagtctttaatttatcacctttcttgcgaaaattgagtagaatcttgcgtttgaaattttatagagcgaaagaatggttattttatgcaaaattcaaccccaagcattggctttgtaagccttggttgcccaaaaaacttggtagattctgaacgaatcttaacgaaataaacaaaaaatccatcttcgtattgaagatggatttttttattagccgaacactttttccaagtgtgcttggtagtctgctaagtattgttctacttgcggacttttaaccacatcgttacataagaatgtcggcaggcgagtcaaaccgaggaactcgttgagtttgtggaaatgcatatacaaaacatccacgcctttgccttcaaagaaatcgccttcgcgagtaaaggcttcaatcggtgcattccaagtcagtgaaagcatgtgtttttttccttgcaacaagccgcctgtgccatagccctcggttggattaacgctgtgtctgccatcactgtgatataacttgccgtgcccattggttaatacttcgtctatgtattttttcactgtccaaggctcatgcatccaccagctcggcatttgccaaatcacggcatccatccacaagaatttttcgatttcagcttcaacgtcataaccagcatcaattacagtttctttgacattgtgtccaagtgcggtcaaaacttctttcgcttttttgtgaagcgtgtggttcaactcgccgtgagaatgaccaaacgccttaccgccgtctaataataaaatattcatctttttgctcctaaaacaaataattataaaaaaaaatggggttgccattatgcctttttacgttaatttttaaaagtatatttgtctgccacgttatttctagactataaggaagattacagcccgtagggtgggaataaaccctagttaaacgcgtgggcttaagcccaccctacattggctacattagctggaattgaaaattcggtaaaaaattggtggaaatcgaacgaaaaatgaccgcacttttaaaataaaaaatcggcagaaaatttcttgccgatttttattaacttttcaaaatcgccctcaatctatcaagttggttttgtgttttttcttgtttttgctcggtggtaagttttggtttatcgcgttcccatagcacatcgtcattaggtaattcagctaaaaatcggcttggttctgggcgaactaattcgccatattgacgacgctcacgacataaggaaaaagtgagttctttttgcgctcttgtgatccccacataagccaagcggcgttcttcttccacgttgtcttcatcaatgctagtttggtgaggcaaaatgccctcctccataccaatcaaataaacataagggaattccaatcccttggatgcgtgtaatgtcatcagttgaacttgatcgctgtcatcatcgtcttcgcctcgctctaacatatcccgtaatgtcaggcgggttaccacttgattaaggttcatcggctcattggtttcatccccttttaacatatccgcaacccagtcaaatagcgtggcgacattcttactttgcatttctgccgctttagggcttgtcgcgtattcgtacaaatattcttcataatgaatcgcagataacatagaacgtaccgcacgttctggttcagaacgttgaatttcatcatyaagttctacaatccatcgaccaaatttttgcaatgaatcataggcttttggcgtgatgcgttgaataagctcaaactcaaaaatagcctcaaacaaactgatgtgtttttcttgagccaactcgccaagtttttgtaaggttgcggtgccaatttcacgcttcggtgtatttacaatacgcaggaatgctgcgtcatcatcttgatttaccaccaagcgtaaatacgccatcatatctttgatttctgcacgagagaaaaaagaagtaccgcccgaaattttgtaaggaatacggttttgcatcagtactttttcgagtaatcgggattgatgattgcctcgatacaaaatcgcataatctttatatttggttttacggctaaaacgatgggcgatcaactcggcgacaatccgctctgcttcgtgttcttcattttttgcttcgatgacaagcaatttttcccctttaccaatggttgaaaaaagtttcttatcaaacacgtgctcattgttatcaatcaaaatattggcacaatgcaaaatacgctgggttgaacggtaattttgctctagcttaatcacgttcaaacgagggaaatcatcgcgtaaacgcaccatattttctggtcgtgcgccacgccacgaataaatagattggtcatcatcgcccaccacagtgaaacaagcacgatcacccactaaaagtttaatcagttcatattgactggtattggtatcttgatattcatccaccaacaaataacgaatttttgcctgccattttgaccgcacttcttcattttgcttgaacaacaacgtcggaagcataatcaaatcatcaaaatcaagagcattgtaagttcgaatttgtgtggcgtaacgttacataacattttgcgaaagtttgatatttagcatcacgcgccaacgcaaacgcctgttttggcgaaatcaaatcattcttccagttagaaatcactgaaattaactcgcgcaataaatccttatcttcttttaacacatcagcggttagctcttttaacaacgcaaattgatcgtgctcatcaaacaaggtcatatttgatttaaagcccaacgctttatattcacgcttaagaatgtcaaaaccgagcgtatgaaaagtggaaacaagcaagcctttagattgttctttgccaatggaatgtgccacacgctctttcatctcgcgtgcggctttattggtaaaagtgacggcggcaatttgtttcggagaataaccgcacttttcaattaaatgggcgattttattaatgattacgcgagttttgccagagcctgcaccagcaagcacaagacaaggacctgtcacatattcaacggcttgttgttgttgaggattgagtttcataagaattattgagcccacgcatagggcagtaatacagtgtctaataaaaatgagagaggcaaatctaagattggcaatccccattgttgcgccatttcaagatcataagcaacccctgcataggcggtatatttttctgttggatcgataagtttgaccacggaaccacaaccagataaaacgataagtgcggttaaaaaaataaagatttttatcatcgtgcttttaacgcattgaacacaggcacaggaactagctcagcgacatcaccgccatgcaaataaatttcacgcacaatggtggaagaaacaaacgcccatttttctgctggtgggaaaaacagactgtctacgccttttgtgagtaaacgattaagggcagccaattgcagttcatattcaaaatctgttgttgtgcgtacgccacgaataatagcggaaatattgtgctgtttaatcacatttgccaacaaatcagaaaagccaaacacttccacattggataaatgcacaacagattgacgaacaagttctacgcgttcctccaaagaaaatagtggctttttacttgggctattcgccaccgccactaaaacacgaggaaaaattaccgcacttctttcaataatgtctaaatgaccgttcgtaatcggatcaaaagtaccaggataaatcacgctcgtcatacattgcgctccaaataaggttttaataaatctaacaaacgctgtaatgcccctcggttttccatcagcacttcatagccagcattacctaaacgttcgcgggattcttttgagtttaataaggcttctacggcgcgttctaaggcatctgcggttgaattaacttccaacacaccttgcacttctaccagcattcgaaatatctcgggaaaattgaaagtatgcttgccagtaatcactggcattttaaatgcaagaggttctaaaggattatgccccccgtgtttcacaaggcttccacccacaaaagcaatatcggaaatgccatacatcaacatcaattcgcccatactatcgcccaaaatcacttgggtattttcatttggtaattcatttgtggagcgacgaataaattgaaatttttcctttttaagtaaatcagccaccacattaaaacgctctggatggcgaggaacgagcaataacaataaatttgggtattttgctaacaaagcgcggtgagattttaaaatgatttcatcttctccattatgcgtgctggcagcaatccatattgggcgatcttgtttccaaagggtgcgcaatgaatcaattttacgtaatagttcatcattcgtattgagatcatatttaatattgcccgtgatattcaatttttcctttggatagcccaaagtggcatagcgttttccactaatgttatcctgcgctgcaatcaagctaatttgtgaccacattgtttgtaagtgcgcttttatttttccgtaacgatgcgcagaacgcgcagataaacgtgcattagcgataacaaatggaatattgcgtaaaaataattgatgaataagattaggccaaagttctgtttccatcacgatacataatttaggttgtacaaaattaataaaacgatggatcgaaaaaggtaaatcaagggggagataataatgaaaaacactatctccaaaagtggctttgacgcgctctgaacctgtgggcgtaaaagtcgtaaaagtaatggataaatgtggataatcttgttgcaattgacgaaccagcggtgtcgcagcaatcacttcccctacggaggctgcgtggataaagatcccttgtggtggtgggcaagacgcattgccataaaaaccataacgttcagccaaacgctgacgataacgtggagatttaacactgagcaagccaataaaacacaatatcaacggctggcaaattaaaagcaagctggtataaaaaaaacgccacataaatgaaattcggttatacttaaaaaaatttcggctagtatagcaaaaaaaggattgaaaatatgcctacaattagcgttgcaatgattataaaaaatgaagcacaagacctcgccaattgcttagataccgtaaaagattgggtggatgagattatcattttagattctggcagcacagataacactaaagaaattgcgctcagttatggggcgaaattctatgaaaatagcgactggcaaggatttggtaaacaacgccaattagcccaacaatatgtaaccagtgattatgtactctggttagatgctgacgaacgcgttacgcccaagttacaacaggctatcttaagtgcggttaaaaatgatcgagaaaataccgtttatgaaattccacgagtgagtgaagtatttgggcgtgaaattcgccattcaggctggtatcccgattatgtggttcgcctctatcgcacaaactatgcacaatataatgattcacttgtacatgaaaaagtggaatttccagctggcacaaaagtagaaaaattgacaggggatttagagcatttcacttataaaagcattcatcattatctagtgaaatccgcaggttatgccaaagcatgggcagaccaacgccaagctaaaggaaaaaaagccacactttggcaaggaatttcacacgcgcttggttgttttgtgaagatgtatttgttaaaagcgggttttttagatggcaaacaaggatttttattagcggtgttatcggcgcattcaacctttgtaaaatacgccgatttatgggagcgcgatcagcataaacactagctagttttgcaaggacaatcatttaaatgatcgtccaccagccccatagattgcataaacgcatagcacgtggtttcgccaataaagacgaaaccacgtttttttaaggctttagaaagtgctttcgatacttctgttttagttggcacagatcgcaaatcaggcacatcattgacgatcggtttatgatttacaaatgaccaaataaaatcactgaaattttcaccgcacttttccatcgccaaataagctttcgcatttttaacaatggcttctaacttggctcgatggcgaattaatcctgaattttgcatgcaagcatcaatatcaagtgcggtcatttttgcaatttttttcggatcaaattgatgaaaagcctcacggtaagattcacgttttttcaaaaccgtaatccacgaaagccccgcttgctgcccttccaaacaaattttttcaaatagcttttggctgtcgaattcaggctttccccattccttgtcatgataatcaatataaatagattgttcgccaacccaagggcatcgagtagtcataacatcgcctttttaagctgttcataaaccgagacaaaatctggcattacgcctcgccataaatggaaagaatgtgctgcttgtgcgactaacattccaaagccatcgctaacattggttaaacctaaacttttgcataatgcaataaatggcgtgtctgtgcctttcgcatattgcatatcataaaaagccgagcccaattttaaaatttcagcatcaactgaagccgttccaccacttaatccagcggaagttgcattaatcaccaaatcataagtttgtagcggaatcgaatccatagagacagcttgaatattgccgtaaggctgaaatctttcagctaattctttggttttcgaaaaagtgcggttagcaagcacaatgttttgttgagcttgtaaaagtggcaataatacgccttttgttgctccgcccgcccccaagattaatacgtgctgatttggacgaagccaatttaaacgttgtaaatccgtcactaagccaatcccatcagtgttatccgcataaagttttccatcatcgagtttttttagcgtattacaggcttccgccagttttgctcgttggctatattcgtctgccagctgataagcgcgttctttaaaaggcgaagtaatattgcaacctttcgcaccctcctcaaaaaatgccaaaagctgttgttcaaaagcatcaagatcgcctaattttgcaatgtattccatagtttgatgggtttgtgcggctaacttattttgaattaacggcgatttactttgcgcaatcggattgccccacacagcataaagatccataaattatccctgtctaaaaagttgattggtgcgcaagtctcgaatttccgatggattatgcgccctgcctaccatttcattcaatactggaaaatctgaaccgaattgtaaccgcacttcatcggcggtacggcaaggtggctctcctgttaggtttgcactcgttgaagttaatgcaaaacccgtgagttcacataaggctttcacagatgggtgatcgcacaaacgtattgcaatgctatcaaattttcctgtgagaaaatgcggggtggtggatttagctggcacaatccaagtcgttggacgttcatatttaccttgcaggcgagaaagctgttcatcgttaatctgctcaaaatcgacaaaaggacggaaaaaatctaagctaggagcgactaaaatcagccctttttccactggacgttgctttaaatcgagtaatttttttaccgcactttcactttgcggattacagcctaaaccaaatacagcttcagtgggataagcaaccacttgattttgtcgaagggcatcggcgatttgttctctattcatttcattcttttacttttattgctcaaaaatatgacggcaagttttatttgcacactggaaaatttgtttttccccatcttcgctttttaacaaagaaagaggaaaatggcacgttgggcaaggcacggaataaggcttggcaggcaaagaaaatttacatttagggaaattatcacagccgtaaaaaatctttccttggcgacctcgacgagaaatcaaatgtcccgttttacattcaggacaagtaattttttcctcagattcagattcttcccgcaccacaaaatcgcattcaggataatgactacaaccaataaacatcccaaaactgccttgtttcaactgcaataaattaccgcacttcgggcaaatttcatcaagtgtttttaatactttatgctccgatcgttgcaaaggacgcaaataatcacattcaggataagcagagcaacctagaaacagcccttttttgccttgtttaatttgcaacggcgcaccacattgagggcaatattcctgttgtttgctatgatgaaaaaggctttgattcataatctatccttatgcttgaagcatttcttccaattcttcctgtgcagtcatccattccgtttctacatcatctaatgctttcttcacatccacttgttgagccaaaagtgcggtcaatttttctttattttcggcattatataattcggtatctgccagttgattttctatgttcgcaagctcagaagaaaatttattcattttttcttctaattgcgtgatttttttacgtaatggtgcagtttgttggcgtaactctgcttcacggcgtttttgttccttgcgattttgaaccgaattttcattatcgcccactttttccgaaactttattttcagacgtactgttttgttcactcagccatttttgatagtcttctaaatcgcctttaaattcttccacttttttatcgtgaactaaataaaattcttccacggtattgcgtaataaatgacgatcgtgcgacaccaccaccaaagaaccttcgtaatccaccaatgcttccgttaatgcttgacgcatatccaaatccaaatggttagtcggttcatcaagtagtaacaaattcgggcgttgccaaacaatcaaagccaacaccaaacgagctttttctcctccagaaaaagatttcactgcttgatttactttatcgccgtgaaacgcaaaactgcctaaataatcccgaacttgttgctccgtttgctcaggcgcgagtttttgcatatgccacagagcagattcgtctgcgcgtaaagtatctaattgatgctgagcaaaataaccaagttgaacacctttagctaattgtaccgtgcctgaaagtgcggtcagttctcccgctaaaagtttaatcagtgttgattttcctgcaccatttttcccgagtaaaccaatgcgcgaacctggcactaaattcagtttaattttacttaaaatttctaccgcactttcgccgatgccataacctgcactcgcttgctcaatcatcactaagggattcggcaaggattgcggtggacgaaattcaaaagtaaaaggattatccacataagcaggtgcaatcagctccattctttctagtgctttcatacggctttgtgcctgtttggctttagtggctttggctttaaagcgatcaatatatttttgtaaatgggaaatcttttgttgttgctgacgatacatcgctgtttgttgagccagtttagtggctcgttgcacttcaaaggaagaataatcgcccgtgtattcgttgagcttctgattttcgatatggaggatttttgtcacaattggatcaagaaaatcacgatcgtgagaaattaatactaaagtgccttgatattgcactaaccatcgttccaaccaaataaccgcatccaaatccaaatggttcgtcggttcatccagtaataataaatctgacggacaaagcaatgcctgtgccaaattcaaacgcatccgccaaccgcccgaaaaggctttcactggctgtattgtttcttcttggctaaatcctaaaccatgcaataaagacgcggcacgcgattgaattgtccacgcatccaaggtttctaattgcccgtgaatgcgtgcaatggcgttaccgtcattgcgttcatttgcacgttcaagcttttgttgcaaacggcaatattcacgatccccttgaatcacataatcaatcgcagaaatatccaatgcaggcgtttcttgatttacccaagatacccgccaatttgctggataattcacctcaccgccctctggcattaattctttttttaataaggcaaaaagcgaagattttccacaaccatttttccccaccaaaccgactttttgcttgggattaatcgtagcagacgcattttcgagaagttccgtttgccctcgttttaaggataagttactaaatataatcatttttctacataggtcttaatttgaggctattttgcaatattttttcttttctcggaacagtctattccgattttatcgattttctagtcaaaaaagccacgtataataagacgcaataaaaactatttataatataacaagtcaatatrrcgggtatatcttaggcattttttacccttagaggaacaatcgacagggttttccctaaaggagcgagcaattttaacaacgtttcaagctgaggattcgtttgtcctttttcaatgcgtgcaatcataggttgcttcacaccgcttaaggtttcaagttgtttttgggaaatcccaagttgctggcgagaagtaatcaattctttaattaaggctacacgcaaattactttctcggatttcttcttcattgaaaatttgctgttcaaactcattccaatttgaacctaatgggctgattttattcatttttcaatctctcttttaattcacttaagcgttgttgggctgtttggatttctcgttttggcgttttttgtgttttcttcataaattgatgtagtaagacaaagcgaccatccattaatcttgcaaacaagatgcgatccctaattggacgaagttcccaaatttcaccgtctaaatgtttcacatagggtttgccaacagacgtcccgagttcgcttaataactttacataatctcgaattttattcagtttaattcgactatctttgctttcattttgagccagagatagcagatactctttcactggctcaatgtcattttggtctctgtaaaagagaatctcgtacataatttatcctatttatctacttatttcaataaccaataagttattgatttttgatgtgtaatcataaatagaaactaaaaatttggcgagatagtcatttcaatctttcgatctagatcgcaaaaatagcgaaaatagcttgattttcaaggagattttgcacaaatgccgatgtttgaacattggctttgaaagagagagtaaaagatagatcctttcttaagaaaaagtgcggtaaaaatttaccgcacttttgattttagataggtttaaaattcaaactgaactgacattttataatttctacctggtgcgtagaagcggttaatgcctaatcctgttgattgatctataacattacttgttccaaatgaacgaattgaacgagcagaatcccaagtaatgtatttacggtttgtaagattatatacaccagctcttatggttaaatttttaattggttgtacatatccaattaaatctagaatagtataagatttgcttctccatttaattgtgctgtcttttttattttcttctttatagaacatattataagtatcttctggatttttacttgctacatgtgtcgtatagaaatcgaaaccaaatttatgatttggatgatcatatcctaaaccatataccatagttctaggctgaattgcattcataggaatattgccattcattctgcctttttgataggtatatttatagcttaggttaaatccatccataaattttgccattttaccaaggaatacttttgaattaatttcaataccttttaaagacgcattatctctatttatattttgataaagagaaaatggtaatgtttcacctcttccagagccgcctactttaaaagtttcttgctttttaaatattaggtcaataaagtttttatagttagttttaaacagacttgtcgagataaatccccaatcatcattatgtaatgtgaaagcaatttctttggtttttgctatttctggttttaaatcagtatttggcaaaatagtgaaatcagggtgtttaaaggtgaaatacatttcatctgaagttggtgttctaaaacctttagaatattttagttgtaaacgaagaaaactcgttggatcaatggttgaaacaaaactataagaatgtgctttatattttttgttctgtttggcgatatagtcaatattttgttgtacattttccttaactttattaggatctgaatttgaattgtttggtaatggaataaataatcctttcacaatatcatcgggtaatttgggtgtgataccgtgtttatattttggttgataatggatattgtcataacgataacccaaatcaaaagataaataatcagttataacaaaattatcaaagagatagactgattttcctgttgttttaatgggtaataagtaagaaaattcaggatcaactcgaggacaaaggttagcattccactcataagtcgttgcacaagtgtgaggttttccagtccaagaatcctcaccaagcgtaggtgttgcccaccattgcacatcagaagcatcgttgccagcacgattaaccatgcgcttcatcgcggtattatatgatccaccatattgtagattatgttcaatatgccaaattttgaagtctttggttaaatctaaatttaattgttgggtgttggtgtccaaatctctctcttgccagaggcgttctaaataaccaggtgaagagggaagaatagattttattttcctatcattatcctttattttagcgaattttttgccatttaattcttttatttcaaggtcaacttctttccattttccatcatagccataataattgttacctttaaaaacttttatttttgcgttattttcacaattaaatattgaacaatcataccaagtgtcagaggggttgtttaggactagtttatcgtctattactctcttatcagtatcaataaatttcttgaagtcataggttttatcactactcttagctgtattgtttttttcctcaaattgaaggtctgaaccatctcgacgtgttattttcccatttgttacttttagtcccgtaggattgtctgtgccttcacaatgtcttacaccagcatcacaatactcatctgtgcgtgcacgagttttaatacgttgatcagaataagtgagttttagcgtatcccaaaatggagtttgagagaaattttcataactaaatgaaatattacgtctctttgttttatcattggtgtgtctagaatcaacttcaggggtttcattaccactacgttgatattttaatgtataggataaatcttgcccacgagaacgatgttcatataaatcagcggcaaaggtaaaacgatgattttctgtaggattgaaagataattttaataatgtactatcttgttcaattttatatggatctgctttttctctttttttaccttgaattttatcgttataatttttataaccatagttctcaagttcatgcccatttctgcttgttgtaaccactagcacatcgaactttttataacgtcctgcaagagtaagggtatcgaatgattgattattttccgtagcgtatccctttttgtaacttacatagtaatccttgtttatgagataatctctcgcatcttttgttttataaattacagaaccacctaaggaaccactaccattcttaatagaatcagccccttttgtgatatttacttcttttaaggtttcaatttctgcaccattacgcgtgttattgaaattaccataaccttcaaaaagctctttaaagccttgagaagataaggtttcagcttgacgtaatccatcaatattaatcgctacacgattttcatctacaccacgaatggcaaaaccgctttgcccaaaacgtccagcttcaacaacagtaacgcccgtttcgtatttaacgatgtctttaatgttgtttgcttgttctctttccagcgttttagctgtttttaccgtttcagcaatttttggtggtgtttttgtatcactattttcggtagaaccagatacatttatttgttctagttgttcagaaacattactattttggttggttggttggttggttggttggttggttggttggttggttggttggttggttggttggttggttggttggttggttgagctgcataagcaacacytgccgttagcccaagcataacggaataggcaagcacgtttaatctaaaattggtcatatttaatcccataaaaaaaataataataattctcaaacatattataggagaaagtattctctcacaatactaaaagtgtatttttgatcaaaatcaagaaataaaaactattctcattatttgctgtatttaaacgtgcttgtttcctataatgcgagccgttgattgttgatattagtaattgtagggtgggcttcagcccaccatcaaacaatcgtaagatattttngtgggctgaagcccaccctacattaagtacgcataattctttctatgcgtacttctttttattttaggagtaatcattatgatgatagataaacgcctaattaacacggtggctgacagcaaaaaatggattggtatcacggtgttgtggaattgggtggcgttagtagttgtagggtgggcttcagcccaccnacaaacagtcgtgagatattttggtgggctgaagcccactctacgttaagtacgcataattctatgcatacttctttttattttaggagtaatcattatgatgatagataaacgcctaattaacacggtggctgacagcaaaaaatggattggtgtcacggtgttgtggaattgggtggcgttagttggtgggattattagtgccgtcgtgttttcttatattttacaggcggcttattttcacgaattaagcctgttaagtgcggtcattttgggcatcgttttgattgcagcattggcattacgtgcgtttgcagggaaaaaatcggtgcaggcgtcttattttgccagtacaaaagtgaagcatgaattgcgtagccttatctatcgtaaattggcttctatgccgcttaaccaagtgaatcaacaatccacctcaagcattattcaagtggcatcagaaggtgtagaacagcttgaaatctattttgggcgttatttgccgcagcttttttatagcttgcttgcaccgcttaccctctttgctttcttgatctttttcagttttaaaacagccattattttattaatttgcgtgccgcttatcccaatgtcgattatcgcggtaaataaaattgcgaaaaaacttttggcaaaatattggtcgatttatgtgggattaggcagtagctttttagataacttacagggtttgattacgttaaaaatctatcaagatgatgcttataaagcgaaagcgatggataaagaggctgagcatttccgcaaaatcaccatgaaagtgcttactatgcagcttaactcggtttcactgatggatttactcgcttacggtggcgcagctatcgggattttaaccgcactattgcaattccaaaatgcacaactcagcgtgttaggcgtgattttatttattctcctttcctccgagttctttattccgcttcgtttgcttggttcattcttccatgtggcgatgaatggcaaagcggcttcagataagattttcacattgttagatacgccagtggaaacccaacaaagtgcggtggattttgaagcaaaaaataacgttcaagtggaaattaaagatctgcatttttcttatagtgaagaaaaaccagcaattacaggtttaaatttgagtatcttaccaaaccaactttctgtatttgtgggtaaaagtggttgcggtaaatcaactttagtttcgttgttgatgggctttaataaagcgcaacaaggtgagattttgtttaatggacaaaacgccctcaatattgaccgcacttctttctatcaaaaagtatcgttggtgagccatagcagttatgtgtttaaaggtacgctgcgtgaaaatatgacgatggcgaaaattgatgctacagatgaacaaatttatgcgtgtttagaacaagtcaatcttgcccaattcgttcgtgataatggcggattagatatgcaactattaagccgaggcgcgaatttatcgggcggtcaaattcaacgtttagccttagcgcgtgctttactacacaatgccgagctttatatttttgatgaagcgaccagtaatattgatgtggaaagcgaagaaattattttgcagttcattcaacaatttaaacaacaaaaaaccattgtgatgatttctcaccgcttggcaaatgcggtaaatgcggattgtattaacgtacttgaccaaggcaaattgattgagcaaggcacacataaagagctaatggaaaaacaaggtgcgtatgctgaaatgttccaacaacaaaaagatttagaacaaattagagaggtggcaaatgcgtaaaaatggttttgttgtaatggggcatttgttgaaattagtgactccacttgcgcacattatggcgtttaccattactatgggtacgctcggtttccttgctgccatctttattatggtgctgggtgcgacggggttagtgaatcttttaaactttgatactcatttaagtttctctggcattttgaccgcacttattgtattggcggtggctcgtggtgcattgcgttatttagagcaaatgtcagggcattatatcgcctttaaattactggcattattgcgtgacaaagtgttttcttctttacgccgtttggcttttgtgaagttgcaagataaacaagctgggcaattagtgtctttagtgactaatgatattgaattactcgaagttttttatgcgcataccatcgcaccaattatgatcgcattctttacctctgcgattttattgttggtctttgcccagctttcaagctggtttgtgcttgtggcattggctgcgtatttaacagtaggcgtgattttaccgattatcaccaccaaattggcacgtgaagatggcagacgttatcgtgaattagtaggggaaatgaatgacttcttcctcgacagcgtgcgtggtatgaaagaaattcagcttttcggttatgcaaaacaacgtttagatgaaattcaacaacgcagccaaaaaatcgatacggcgtttgagcgcattaaagaccaagaagcgaaagttcgtgtttatactgaagtggcagtatctgttttcaacattattatgctgtttactggcttaattttatttagcttagataaaattgatttcgctgcctttttaatcggcgtgattttattgatgtcgagctacgggccagttatcgccttaagtaacctttcaagcaacttattacaaaccttggcttctggcgaacgagtattaagtttattagcggaagagccagagttaaaagatgtagaaagtgcggtagatttaaaagatgtttctcgcattgatgtcgagaatgtaaacttcgcttacggcgaagaacaaattttatcggatgtcagcttatctgtgaaaaaaggggaaatattaggtattcacggtagaagcggcagcggtaaaagtaccttgttaaaactgcttatgcgtttttacgatccaaaatcaggtagcattaaaattaacggcgaaaccttaccgaatatcaacacttgcagtttgcgtgacaatatggcgtacattactcagcaaacctatattttcaacgaaaccattgaagaaaatattcgcctcgcacgccgtgatgcaaccttagaagaaattatggaagcggcgaagaaagcctcaattcatgattttattttgagtttgccacaaggttatcaaacaaaaatgaccgaattgggtggcaatctctctgacggagaaaaacaacgtatcggtattgcacgagcatttttacacaatgcaccgattatcttgcttgatgagccaaccagtaatttggatagcttaaacgaagcaatgattttgaaatcattactcaatgtgaaagctgaaaaattgattattctcgtcagccaccgccaatctaccatggcaatttgtgatcaggtaattggcatagaaaacggcagaatgtcctaaattaatataagaaaaaatcgcactgttaaaggtgcgatttttttgttagaggaaaaaagtgcggtgaaaattccctttggattttatagttcaggttcatttaataggttaagcaaagctaaacgcttgcgataagttttcagcacgcaatcaatatgtggctgcggcataaaggattgtgaataaatctgctctactttttccttttcttgtataatttcaggaattaatttttgaataatcacatttttatttaatccaatattttccccaaactcgacaaaatcatcgccgatatattcaccgtattgagtattaaatcctttggctagtgtggcattaccttcttctcgcgctaacaatggcaaagcaagtagtgttgaattaaatatttcaggatagggcgacactgacacaaaatcataaattggagcaagttttggatgactgtttttgggataaataaatgaaaaattgcgtaagtgaagatcattatttcctaataaataagcgtaaataattcgacgaaaaatttctcgttgctgagctaaatgattttctgtgtgctgcaaaataaacttagcaatttgttcataacttacatattgctcattatctgcacctatttttccatacttgtctcgaatattcattgcaccatcaagttgttcttggtgcattggtttttgctgtttatcacgatcaaaacgcgttataacaaaagcaaattctttatgattttgttcgccagcaaaagaaactaaaccattttctggcacatcaaaccctaattctttcataatgcgcatggtggcgtgttcattttcagctaaaaaaggatactcttctggagagggctttaaaatataatttccctgttgatttacgctgtcaaagtgctcatctttgataataagctgtaattttggttgaaaacctgaaatgctcattccttgctgtttttggggtttcactgtaataaattcttggcgagaaaagggtaattcaggattaaaatgtttattgtctgtaaggtaatgcaaaccttcagcactgtaacctgaaagtgcttcatttttcttcaatggctttaataaaatacgacaaaaattcattgtttttcttcctgaatttgcactgcgcctaacatattttccccgttattaagtaaaaagcgaaacatatcgctttcatcaattcgttgatgaagtgcatatttgtgttttagccagccttctgggacgagcgatgcaaaataagggaataaggtgtcagaatgaaaaggactttgctcaataggaaagctgagagagagcggtattccttgataatcggggttgtaagaaaaatgaaaaccacgatgatcttctctaagtaagccaataaattcgccgtagagaaatacttttcccgagcggactaaatcgcgcatagtgaaacccctaatgtttgagcaacaagaaacacggttgtaaatctcacttggcttggatcttgaaataatcggttcaaggtagaaatagacacgccagtttgcagttctagcatactaagctcaataccaagtgatttacgcttatcattgagcatttttccaaatgctttgagatcggtaattttccctgcgtaaagttgttgtctttgcgcttgctcataggtaatgactgatttctgaagcttttttaattcatcaatttgattttctaattgtgcactaagattgtccatatttgatattttttnctttttatggaaatattttatatcatatatgattttttgtttttagaatatcttttttgattttttttagggaaaaatttgaggaattattcaaaaatgatacttaaaatctgctctgtccatttgtaatttgtcccattttttggagagcagattaaattaattgaaatgttgtttgcttgagctaaatattcaaaattttataaaggtcatccaaataatgaatggattgaattttacgaattgtgcgggattttcctcgaattaaaatggtttcagtactggctaaattgcctttgcgggagatacctttaagcaaatcgccattggtaatgcctgttgcagtaaatacaagattgtcatcacgcacgagatcttcaagttttaacacttcattcacttttacgcccagtgctgcacagcgttgaatctcattagctgcaatttttttattttcttcggtgtcgctttttacttcattgcgtgggattaaacgagcttgcatatcaccacctaatgctcgaatggctgcagcagctgccacgccttctggcgcaccaccaattccataaagaagatcgacttcagcatcaggtaagcagcaaagcacagaacctgccacatcgccatcaggaattgccaatactttcgcgcccaagttatgtatttgtttaattacagcatcgtgacgtggttttgctaataccattacggtaaggtcagaaagggattttcctagcttagatgcgatgcggcgaagattttgttccagtggtaaatttaaatcaatgatgccttttacatttgaacccaccactaatttttccatatacatatcaggtgcttttaaaaaggtatttttgccacctgcagccaagacagaaatggcattagattgccccattgcggtcatatgtgtaccatcaataggatctactgcgatagaaactaattcccctaagccagaaccgactttttcgccaacataaagcattggggcttcatcaatttcgccctctcctataacgatttcagcgtccatatgaattaaattcagcatataacgcatcgcttttaccgctgcatcgtctgccgcatttttatctcctcgaccaagccacgtgtaagctgctagagcggcggcttctgttactcgtgaaaattcaatggctaatgctcgattcattattattctccttctgcttatttttcaagattatggtaaaaatagcatcattctatcactgagtaatcgtttgcataataaatttttattcaatgctttaaaaaggtaaatttactgggtaaaatacccctaaacttacccatatttaaaaggaaatcattatgtctttagaaattttagaccagcttgaagaaaaaattaaacaagcggtagaaactatccaattacttcaattagaagttgaagaattaaaagagaaaaacgcagaatctcaaagaaatatcgaaaacttacaaactgaaaatgaacagctgaaaaacgaacatcgtaattggcaagagcatattcgttcattacttggtaagtttgataacgtttaatcgtagtaaaaggcttagattttctaagcctttttattttaatcatttgaataattttcttttctctttgagaaaaaataaatataggataataaaatgcacatttgcattctttcaggcagcactttaggtggtgcggaatatgttgccgagcatttaaacgatgttttagaaactcaaggtttctccaccgcactttttcacggaccaaatttatctgacattgaaaacgagaaaatttggcttgttgtgacttcaacgcatggtgcaggcgaattgccagacaatttaaaacctctatttgatgaattagcgaatagccaaaaggatttttcagatgttcgctttgcggtcgttggattaggtagttctgattatgatactttttgctatgcagcggacaaagtggagcaaacacttcaagcaaaaagtgcggtaaaaatttgtgagactttaaaaattgacgtgttaaacgtggatgatcaagaaagttatgctgaagaatggttgccgagttttattgagggattgaaatgatcgccctaattcagcgtgtgtctcaagcaaaagtggatgtaaagggcgaaacaatagggaaaattggcaaaggtttgttagttttgcttggtgtagaaaaagaagataaccgagaaaaagcggataaactcgctgaaaaagtgcttaattatcgaattttcagtgatgaaaatgacaagatgaatttaaatgttcaacaagcacagggggaattacttatcgtttcgcaatttacattagcagcggatacgcaaaaaggtttacgcccgagtttttcaaaaggtgcgtccccagcattggctaatgattatatgaatactttatccaaaagtgcgcagagaaattacctgtttcaacagggcaatttgcagcggatatgcaagtgagcttaacaaatgatgggcctgtgacgttttggttaaatgtataataagaaaatctaagttggcaataagctcactgttttacatttgttttattaaatggtttagttaatggaatattctcgttaaagcgtataaattccatcaattaataatgaaccatatattcggttggtaagcaaaaaggcggactgaagccctccattgctccctcacccataaatgggcgtttcctttcaccaatggtcacttaataataacgagcaatcgcttattattttactaataaaaatgcgatgaaattcttttcaaattgcaccgcacttttaagaatataagaatagtaaattattgtcggattaaaagagcaacggcttcacaagcaatcccctcttgtcttcctgtaaagcctaatttttcggtagtcgttgcttttacattaacttgctcaatatcgcattggagatcttcagctattttggcacgcattgcatcaatatgtgggcgcattttaggtgcttgagcgatgatggtaatatcaacattacctattttatatcccttttcttgtacttgacgaaacgcttcacgcagtaagcctcgactatccgcatttttatattgcatatcagtatcggggaaaagttttccaatatcgcctaaagccgcagcccctaagattgcatcagttaatgcgtgtaatgccacatcgccatctgagtgcgcaataaagcccgtatgataaggcacttctacaccaccaataattaatggacgatcttcgccaaaagcgtgaacatcaaagccgtgtccaattctgatcataatttattccttgttaaataaaattctgctaatgctaaatcttcaggacgagtgacttttaaattatcgctacgtccagccactaagtgcggtcgaaatccagcaagttctattgctgatgcttcatctgttatattcgcaccttgttgaattcctgtggaaagcgcatctcttaatatatctactgggaaaaactgcggtgtcattgcttgccaaagctggctacgatcttctgtttttacaatacattgctgattgtccgctcgtttaatcgtatctgttactgggattgccaaaatcgcaccttgtttatcttcaatagctaacaatttatcaatatcagcatgttgtaaacaagggcgagcagcatcatgnacaagcacccaggcatttttttccgcaattgcatttaaaccatttaagaccgattcagctcgcgttgtgccaccttccactaactgaattttaggatcgagcgatagtgtagaaatataaggatcatctttgcttaccgccaagataattttagatacggcaggataagaaagcatcacatcgagtgtatgttcaagcagtgttttgccaagcagcgttaaatattgtttcggtttatccgcttgcattcgtgaaccaacaccagcagctggcaagaccgcaataattgaacgagccattatttactctcttttacaatatgatagaacacttcattttctttcactaagccatgttgcattcgtgcgcgttcttcgatcgcttcaaaaccttttgttaatccttgaatttctgcattaatacgctgattacgttgagatagcttttcattttctgcttgattttccttaattttctcagcattttgacgataatctaaaaaaccgttactgccaaaccaaaaattatattgaaacaatactaatacagaaagaaggattaaaataagaagtcgcatacggatatttattgtgagtaaaattttaacctgtttaccgtgaaaaattaggaaaaacgataaaatgaaagaaagtgcggttaaaaattcttttattttaaccgcacttttttgtataaaaattattttctagagagaggtggaacaaaggttaaacctaaatcccaaggttgctcaatccaagtattttgtggaatatcaattacgtaatcatccactaattccgcacctgcaggttttgcaaatacagtgacaaattttgcattagggtacatttgacgaatggcacgcgctgtattacccgtatcaactaaatcatctaccacgataaatccttcgccgccatttggcacttgggctgcatgaagaacttgtagttctccctgattattgtgatcgtgataacttgcgatacaaacggtttcaatatgacgaagacccaattctctagccaatacagccgctggaaacaaaccgccgcgactcaccgcaataatacctttccattgggaagctggaagtaaacgttctgataatctgcgagcatgcatttgaaacatatcccaagtcaccacatatttttcgctcataattgcaccttagtttaaatttatcgagaaataaaaaattgcgtaaggataacccgaaatggcgttttatgctattatttcgtcaatattttcagtaaaaaggagcaattatgtctgaaattacaacacttcaaccttcactgttatggaaatggttcgatcaaatttgtgcaatccctcatccttctcattatgaagatacgttagctaactttattgtaaattgggcaaaagaaaagcatttttttgttgaacgcgatgaagtaggtaatgtcctcattcgtaaacctgcaacaaaaggaatggaaaatcacacgcctgttgtgctacaagcccatctagatatggtgccacaggctaatgaaggcaatccacatgattttaccaaagatccaattcaaccttatatcgatggagaatgggtgaaagcacgaggtaccacactagggtctgacaatggtatcggtttagcctctactttagcggtgttagaaagcaatgatttagcccatccacctcttgaagtgcttttaacaatgacagaagaaacaggcatggatggcgcaaaaggcttacgtcataactggttacaatctgaaattttaatcaatacagataccgaagaaattggcgaaatttacattggttgtgcgggcgggattaacgcaaactttgaaattcccgttcaatatgaaactaatacgtttgagcacagtgcacaaatcacccttaaaggtttacgtggcggccactctggcggtgatatccatacagggcgcgcaaatgcaattaaagtgttagcgcgagtattagcaaaactctctcaaaatcaaccgcactttgctctctctgaaattcgtggtggctcaattcgtaatgcaattcctcgagaagcagcagctgtgttagcctttaatggcgatgtaaaaaccatagaaagtgcggtagaaaatctcgcggttgtgcttaaagaagaattagcaattgcagaacctaatttcacactttttgtagaatccgcagaaaaagcccctaccgtattcaccgcacaaagtactcaaacggttattaacgcactcaacgtattgccaaacggcgtaatccgcaatagtgatgtagttaaaaatgtcgtagaaagttcattaagcgttggcgtattgaaaacagaaggtaatgttgtaaaaagcaccattttagttcgttcattaattgaaagcggtaaatattacgtaactgaaatgcttagctcacttgcaatcttagcaaatgcaaaagtcgagttttctgcaccttatccaggctggcaacctgtaaatgactctactatcttagacgttactcgcaaacattatgctgaagtgctaggcgagcaacctgtagtgaaagtcattcacgcaggattagaatgtggtcttttaaaagaacattatccaaacattgaaatgatttctgttgggccaacaatacgaaatgctcactcaccagatgaaaaagtggaaatcgcaacagtacaaacctattgggatttattgacaagagtacttgccgatattcctgcgaagtaatctaatattaattaaaagtgcggttaaaatttcttttgttttaaccgctcctttatttttttcgtttcgctcttgggtgcgcctgatcgtacacttctgccagatgttggaaatttaagtgagtataaatttgtgtggtggaaaggttgctatgcccaagcaattcttgcacggcgcgtaaatcagaactggcttccaacatatgcgtcgcaaaagaatgacgtaatttgtgcggattaagatggctatttaagccttgacgaataccccaagtttctaaacgtttttgaatagctcgatgagaaatgcgatttccaagctggctaacaaataatgcctcatcttttgggttaaataatgcccgcacttttaaccattcttgaatggcatgcgaagcgtaacgcccaaacggcacaactcgttctttgttaccttttccaataacgcgtacttcccgcacacgggtattaatgctgtttaaatctaagccttgtaattcagataaacgcaaacctgaactatacattaattccaaaatagcacgatcacgaatatcaattggctctttgctatcgttggcaagcaattgttgaacttgctcgccatccatatttttcggtaaatgcctgccttgtttcggtgcagaaatgcctgtggcaggatttacttttaattcgccttgttgcactaaaaaactgagaaatcgacgcaatgcagataaacgcaaagccaagcttttttcttttaagccttgttttttgctttccgctaaaataaagcgcaccacgctaggcgtcacttgtgtccaagaatgaatatcttgttgcgctaagattttgatggtggcatcaagctgatgttgataattagtgattgtgtgaggactcatttggcgttcaatccgcaaataatcccaataacgatttaacgctgttagcatgacaaactcaattcaaataaacgttcttttgggttcaatttaaacccttccgattccaacattgaatattgattttgcgctaattctgccactaaacgattggattgcgtgaaatgcacaaagtcttttgctttagaaatcaacgccgcataaatttctgtttgttgagcatgttccaacacaaaaatatcggtgatttgccaatagcgttgtaattgtaaagaagaaaggcgagggaaaagctgcacaaagccaatagccttttcattttcatccaccgcaataaaaaacaggctttcattaaaacgcatacgattagttaaaaaagctaaggtacgttctggattctctgcttgcccataggcttggcgataggcttcaaaaagaggaagaagcacttcaatattccattgttcagctttgaaaagtttcataattggttattttttattggttccatacaggtaattgtagctttttagctcaagataatcatctttctgtgagaatttttttaattttatgatcttctgcaaagaataggggcgaaattttggtatagtaagcaagttaattttatcaactatggagaaacaaaaatggcacgtcgtcctttagttatgggtaactggaaattaaacggtagcaaagcattcacgaaagaattaatcgagggattaaaagcggaattacatgatgtaacaggttgtgatgtagcaattgcccctcccgttatgtatttaggtacggctgaagcagcactttctggttgtggttgcagctgtggcggtaaaagtgtgattcaattaggtgcacaaaacgtagatatcaatgtgaaaggtgcatttactggtgatatttcaactgaaatgttaaaagatttcggcgcaaaatatatcattattggtcactctgaacgccgcacttatcataaagaaagcgacgaatttgtggcgaaaaaatttggtgcattaaaagaagcaggtttagtgccagtattatgtatcggagaatctgaagcagaaaacgaagcaggcaaaacagaagaagtatgtgcgcgtcaaattgatgcagtcatcaatgcattaggcgtagaagcattcaacggtgcagtgatcgcatatgaaccaatctgggcaattggcacgggtaaatctgcaactccagcacaagcgcaagcagttcacgcatttatccgtggtcacatcgcagcgaaatcacaagccgtggcagagcaagtaattattcaatacggcggttctgtaaatgatgcaaatgccgctgaattatttactcagccagacatcgatggcgcattagtgggtggcgcatcattaaaagcccctgcatttgcagtaattgttaaagcagcagctgcagcgaaaaactaattttcagttaattagaataacaacaaaagtgcggtaaatttttaccgcactttttttatatcttatatttttgatgaatgggttagtaagtggtatcaatcggcaattctgctctgcaccatccatcaaatccgccaatcatactaaatacatttttatagccttgttccacgagaaaagtcgctacatttcgactgctcacgccgtgataacaactcacaataataggcgaatcaaaatctgctagttcttcaaattgcaaaaaactttggtttgttaaatgaaaagcacctttaggatgtgaataagcaaagcgcatattatctcgaatatcgactaatattgcgccttgttgcatcatttcccaagcttgctgtggagttatttctttaaatggcatttataaacttccttttgcgtgtgtttgtaaacgccatcaaccataacaagaatcatcgcgatgactaaacaaataaaaagtgggtagctttcgctatcaatttgttctccgatcaaaaatgatacgcatagcatcataatagtttcaacataaccaagcagaccgagtaaattcataggaagcatattactggctattacataggcaattaacgcagtaccgctgattaatcctagtaatacaagcrgcccccaaataaacggattggtttgttgtactgtcgcgaaatctgtttgtaaagcaaaataaatactgacaggcataaggcttaacatttctaaacaaaaggaggcaagatcggtattttttaatgcttttcggatagaaaaatatgcggtgtaacctaaacagataacaatggcttcccaagaaagaccaccttttagcacaatattagaaattacgcctaatgttgcaatgataactgcaataaatttgaatgttgaaatgcgttctttaaaaaacacgcgacctgccgccaccattacaattggtaaaagtaaataaccaaaagatacacttaatgaactgccattattcggtgcccaaagaaaaagccacatttgaaaacccattaataatccgcaaagtaaatatgacaatgctaagtgcggtcgtttttgaatgcgttttaaacgttcaattaaagccgctttttgtttaaataatgtgacggacaacaggacaaaaggaaaagtaaatatcatccgataaccgaaaatatccgtgccactcaaaggttttagtaacgtagaaaaataatacatatagccaaataaaaacgaggctaataatgaaacgagaatacctttaaacataagaaatccttattttaaaccattatttattctattctaacatcgcccaaaatgcacggactaggggctgttcgagatttcttttttgggtgcaaatacctaattcaaaaggctcaataggtttatcaagattaagtctggaaatttggttattcattgggctgctgtcaattactgcatcaggcaacattgctaatccaaatcctaatcccaccattggcacaattccttcgtgtcccgcaacagtagcataaattttcgggtgtttaatttgtttctcccttaaccattgttcaattcgctgccgtgcgtgaccttcaacgggaaaaataaaaggcatttgctgccaatcaataggtttttcttgcaataattgtgtcgccaaacaagccactcgcggggcaattagggacaaactaatatcatctattttatgaaacactacactagagggcagattatttggtttccccgcaagcgcgagatcgacttgttgcgcttgaattaattctagtgctaacgctggatcgcctgtagtcagttgaatttccactttaggataacgctggcgaaattctttaagtacgtgaggaagatggctataggatgcggttacagaacaaaaaagtttaatttcaccgcaaagttcatcggattcatctttcagttgttgtttaaattgttgccagttttgccattctgttttagcaaattgcaaaaatttctcgccatattcagtaagtttgacttggcgattatcacggataaaaagtgtcttccctaactcgtcttccaatcgttgaatttgacgggaaagggtggatggggacatgtggttttgggtggcagttttggtgaagttttttgtatcactgaggtggatgaatatttgtaggtcggtaaattccataatttcttcttttatttaatatcgggtttcgccgatggcgacctactttttctttgctcgtgcaaagcaaaagtaggcaaaaagaaaacacgccctactttgccttatttcctgaaaaattggaaatttgcttaacggaaattttctgaactcgctacgctcaaacagacgaaaatttcctacaaatttccaatttttcaggcggcaaagaagggagctaatttattctttcttcaatttaaagtgcgggtaaaatttagcgtattttgaaaaataccagaaaactaaccgcactttttaataacgctctgatatattctgagccccatataaatcgcctttgcgactttcaatttttaggcaatttgcgtctgtttgagcgtagcgagttcagcaaattgccgttaagaaaattgaaacaaagcaaagaacagcgatttaactggggcgtgttttctttgcctactttcttttacacgagtaaaagaaagtaggtcgttcatcgagcgaaatacgatgccaattcacaaaaaaaaataattgcacaaatcgcaacattacattcccataatatcactttacgcaacaacaaaaaatcctataatcaaaccacaacaaaaaaatatgcaaacacaacatcatacaattatcaaccttacacaattaaggacaaaaaatggctaactatttcaacacattaaatttacgtcaaaaattagaccaattaggtcgttgtcgttttatggatcgcgaagaatttgcagatgaagcaaacttcttaaaaggcaaaaaaatcgttatcgtaggctgtggtgcgcaaggtttaaaccaaggtttgaatatgcgtgattctggcttagatattagctatgccttacgccctgaagcgattgcagaaaaacgtgcgtcattccaacgtgcaaccgaaaatggttttaaagtgggtacttatgaagaattaattccaactgcagatttagtcgtaaacttaacaccagacaaacaacactctaaagtagttgccgatgtcatgcctttaatgaaaaaagactctgcatttggttattcacacggtttcaatattgttgaagttggcgaagaaatccgtaaagatattacggttgtgatggttgcgccaaaatgtccaggtactgaagttcgtgaagaatacaaacgtggtttcggtgtgccaacattaatcgcggttcatcctgaaaatgacccgaaaggcgaaggcatggcgatcgcaaaagcatgggctgctgcaactggcggtcataaagcgggtgttttagaatcttcattcgtggcagaagtaaaatctgacttaatgggtgagcaaactatcctttgcggtatgttacaagcaggttctatcgtatgttatgacaaattagtggcagatggtaaagatccagcatacgcaggtaaattaatccaatacggttgggaaaccattaccgaggcattaaaacaaggcggcatcacattaatgatggatcgcctatcaaacagtgcaaaattacgtgcatttgaactagctgaacaaatcaaagaaagccttggtttcttatattacaaacatatggatgacatcattagcggtcacttctctgcaacaatgatggcagactgggcaaatggcgacaaagatttattcgcatggcgtgaagcnacaggtaaaacagcctttgaaaatgcgccaaaatatgatggcaaaattagcgaacaagaatattttgataacggcgtattaatgatcgcaatggttaaagctggtgtagaattagcctttgatgcgatggttgcaagcggtatttatgaagaatcagcttactacgaatcacttcacgaattgccattaattgcgaacactatcgcacgtaaacgcttatacgaaatgaacgtggtaatttctgataccgcagaatatggtaactacttattctctaacgtagcgaccccaattcttgcaaaagaaattatccctaaccttcaaaaaggcgatttgggcgagccaactccagcagtggaagtcgataacattaccttacgtgatgtaaacgatgcaattcgcaaccaccctgttgaattaatcggtcaagaattacgtggttatatgacagatatgaaacgtatcgcagtcgcaggttaatgttaaattgaactgaattaaaaaccgactttgtcaatataaagtcggttttttcatagataaaattaatcataaaaatgcacgttaattaccacatgcatttttcttatttaagcatccatcgacatacaaagtaaagttaatggatgaatacaagtcacgttagatgacatatcaatttgccatttacaggtttgacattcagatataacgtaatcaaatccaccctcgttaatattatcgaatagatttttaccaatagattgtgaaatttcatagttttctgatttaaaaccgtaagtcccagcaataccacagcattggctaggtaacataatgatttctaaactcggaatttttttcaacacttccaaagtataaggtgcccaacccgccttatctacgtgacaagcggtgtgataagccactctaagtttaagtggtttcaacggtaatgttttaccttctttgaaaagctgatataaaaatggggttaccatatggatatgcggacggactttggcgttatcgatacctaaaatatgatggtattcgtcacgcagattaagtgaacaacttgatgcctcactaatcacatctattccattttcatctaccatttttccaatgtaatcggtattgaattgtgcaatattacgagcgcgattaggaaaaccgtttaccattaatggtaagccacagcatttttctttttctaataacattaccccaatattcatcgcattgaacactttaaggaattctttgccaagctgtggattattataattaacataacaaccgtggaaatatgctacttttcgctcaaatttttgttggtcttgtagcgcatttttcatataccagctacggaacgtaccaaacgcatatttaggtaaagtacgtttcttactgatattaagggttttttccaacataaatttggtggctttcagacccgtaatggtgttcacaatgggggcaagtggagtattgattttccccattacatctgtgttacttaaaatcgcatcacgcaatttattcattaacggttttttagactgcgctaagtgattattacgcgcacgtacaattaaatcgccaattttcacatcagacggacaagccacttcacaacgtttacagttggtgcaatatttaagtgcttcatcataaagttcagcagattttaagcgtaaacgctcaccatctgggccagattgttttggccctggataaagcggattattacgtgaaacaggacaaacagcagtacaagcagtacatttaatacagctttcaaaactttcatcaatatatttatagctttcaggcgaattaagggattgttttgcactatcaatgagtcgttgaatattattatccatattattcccccttatttcgctaagatttcatctgccactgccaaggcagttacaacagccacacccgaaccacaaccaagttcaagggcattaaaaccaccaatcacattaccgacggcatataaattcgttaaaaattgaccgcactttttcacttggcactgggcattaatcgctacgcctgctgattgataaggttgtggatgagcaaagcgatgagcagtccaagtgaaacgatctttattgttaaacccttcaacaccgataatatcggattcaaaaactggctcataaattttatcaaattcggaaataagccctttgctgaagaaacttcctgacgccaatacaaaattatcggcagtaatttcttcatcttcgagcaaacgagtattgatacaacgtacttgatttccttcaaatgttgcattcaatgcactgtcgccattaatcattaaaccaccaagggattcaaatttatggcgtaattggattcgttggcgcataccaagtaatgatggtggcagtgttggtaattcaaataatgcaagtttagttgcatcacgaagtgcggtcataaattcttggttttctaaaccaaagcaagcaggtaaaaagaccgcttctgcaccttgcgctgattctataatttctttaactaaatctttaaaagcgagtttgtgttctaaaagttgagagatattgacactacggaactcacgagcatttttgcgaagttcatctaattgtggaatatttaagaaaccactcgttacttcacaatgttcaaattgtgggtttaacactaaatttgccgctaaaagttgaggttgaaaatcgtgataaccttcaataccaagcactgcaatacgtttatgcggaaaaggttcattaccttgcacagttggcacgctatttggcgaaagccacgcaccgcgtaaactgcctaagcctgttacacgccagtgatttttttccgtagaaccaattaaatcaagatgtaattcattggctaaacgttcaaaatcttgtgctttagcaagcactttctctgcacccaataaactataagggtgggcaggtaattcattgcgaagtgcggtaatattttcttttaaattttctactgcgcgattttccccatatgtcgttgatggcatacggcttaataaatctaaagagccagatgcaaaatcaatggctgcttgaccgttgttgataatcacgcaacgtttaccgcgttgttgaagggcgatggcacaggttaaacccgccaaaccaccgccaataatggctacatcaaaattcattgctatccgtcccttgttgtgcttgttcatcaagcggtttcacatcatttaaacctaatacactagcatacatccaagaggtaaattcggcttcgcgaatagcttccccccaagcaatcggttcaataccacgccagcgttcttccataaaggcggaaagttgagtggttgattgacgtggtgttgccacttcaaaacgattcattagtcctgcagcacgacaagcacagagttcagcttgacaagttcccattccaactcgggaacgacgacgtaaatcgacgagattatttacatccagttcatcaacagcgtaacgaacttcccccgctgttaccgcttcacattcgcaaaccattgaacgatctaaacgttctttttcaagcaaacgagtagcccgtgaaccgtgacgatatacggcagaataacgaatagtacttggtaatgaaatgactttttgattggtctcttgacgactttcagtagagcctggcaaaggttgctctgcagtcacacaacgtgccgttttattgagttttttacaaacaaggtcagtcgcccattcagccattaaacgataagtcattaacttaccgccagtgatagtaataaagccatctaagccatcacgttctgcgtggtcaagtagcacgataccacgactcacatttcgacctgatggatcatcatcgcttgcaactaatggacgcaccccagcataagcacgtaatacgcgagtatgacgcaagctaggtgcgagtttttcaccttcacggaaaagaatatccacttcctctggtgttacttccatattatcaatttgatcataaggaatgcggctagatgttgttccgatcacacaaattgtatcgccagggacgagaatatccgcatcagcaggtttacggcagcggttaattacaagtttattaatgcgatgacccattacgagtaatgcgccttttgcagggaacattttaattttgagatcggcatattccgcaatcccttgtccccaaataccaccagcatttacaacaagcggtgcaaaaaattggcgttctctgcgatttttgtgatcgtacgcattcacgccaatcacttttccaccttcacgaatcaaattttttacttcgcaataagtgaacatttttgcgccgttttctgtggcgtccatcatattagaggcggttaaacggaatgggtcaatagaaccatctggcacaacaacagcacccactaaatctgggtttacagaaggctccataattttagctagttcaggatcaatggcttgtgcatcaattccagattttgcacagctctcaaggaaggttttttgatagtcgagcgaatcttcaggcaaagtgataaataagccttccgtttcatctacgcaatgacgcgcaattttgcgcaaaatgcggttttctttaatacattcttcagcagattcttggtcgttcacggcgtaacgtgcaccactgtgtaataatccgtggttacgtcctgtggctcctgtcgcaatatctcgacgttccaataaaatacaatcaatgccacgargtgcgcaatcgcgcgcaatacctgctcctgttgcgccaccaccgataatgatcacatcagtgctaagtgacgaaagatctccaacatctttatagatactaggcgataatcccattgtttacccccgattcccaaaatgtaagaaaaaataatataaaaagtgtaatcattgtagggaagtgcggccaaaattaacaacattttgagtgtaaaangaaagcgattttgtgatattgatcacaataattttcgcattcgctcaaacggtgtaaagatttgtgaaacacttcacatttttgattttttttactttcttattttttattttcttttatgattcgcaaatcccttactgtttcaaaagggtaaatttagatgacacataattaaaaagttggagaaaaaattatgtttggaccattcaaacccgctccgcatattgcggaacttccagcggagaaaattgattccacgtataaacgcttacgttggcaagtgtttgcagggatcttcttcggttatgctgcatattattttggtgcgtgcaaactttgacttagcacaaccaggtttaattcaagctggcttgtactcaaaagcggaactaggtgttatcggctcagcggctggtcttgcttacggtttatcaaaattcgttatggcaggtatgtctgaccgttctaaccctcgtgtattcttaccatttggtttattgctctctggtttatgtatgaccttaatgggtttattcccatgggcaacttcaggcattgccattatgtgggtaatgatcttcttaaatggttggttccaaggtatgggttggcctccatgtggtcgtactatggtgcattggtggtctaaatctgaacgcggtactatcgtgtcaatttggaatacggcgcataatatcggtggtatggttccaggtgcaatggtgttattagctagtgcaattttcttcagcactcacggtattgaagcgcaggcgaaagatgtttggcaacaatcattatacttccctggtattgctgcgatgatctttgcaattcctgtgtacttcgtgatgcgtgatactccacaatcttgtggtttaccatcaatcgaaaaatggcgtaatgactacccagatgactataacgaaaaaacttacgaaaacgatttaactgcaaaagaaatcttcgtaacttatgtattaaaaaacaaattgttatggtatatcgcgattgctaacgtgttcgtctatttaatccgctacggtgtattaaaatggtctccagtttacttgagtgaagtgaaacacttcaatatcaaaggtactgcatgggcatacacaatctatgaattagcagcggttccaggtacattattatgtggttgggtatcagataaagtgtttaaaggtaaacgtggtttaactggtttcatctttatgatcttaaccactgcagcggttgttgcgtactggatgaacccagctacaccagaagcagagcttgcaaactactcagcttggtatgaaaacccatatcaattaactgatttcgtattaatgaccttaatcggtttcttaatctacggtcctgtaatgttaattggcttacacgctcttgagcttgcaccgaaaaaagcagcaggtacggcagcaggtttcactggtttattcggttacttaggtggtactgtatcagcttcagcagttattggttgggctgctcaacattacggatgggacggtggtttctacgtaatgatcggcggtggcgtattagcagtgttattactcttaatcgtaatggttgaagaaggaaaacacaaagcgaaattaggcgatacttacggtactaaataattagcttaaaaaaggcggtgggcaaattgcttagtcgccttttttgtaactatcataagaataataaaaagataagtatcatttttgggaaaagtaaaaatgaataatgaaaatatggtaagagttttctatgtcttattaatggggttaggatttcctattatgagatttatgagtattcattttgaaactttaaataataattctgttagatttttatctggaggatcattatttgttattatttgcttaattaaatttagaagtgagttaaagaaaataattggtgaaccnaaaattattctttatttatttatttatttatttattttaggtatttttatgactggaaatatgtttttctttattaatggtttgaaatatacctcagcattggcaggaagtatctttggaatacttgctatgcctttagcaataattatagctggaatattctttaaagatgaaagagatcgtataagacaaaaagaattttatattggagaattattagcaattattggttcgctaatattcgtaataaatagttcaaataatgatggaaatacagacttttttcttggggcaatatttctttttacagctatttttattcaatctgtacagaatttaattgtaaaaaaagtagccaaaaagataaatgctgttgtaataagtgcatcgacagcaacaatttcaggagtattatttttatgtttagcttttaatactaaacaaatatatttattacaagatgttggcattggaatgttgataggtttagtttgcgctggcttttatgggatgctaacagggatgttgatggctttttatattgttcaaaaacagggaatcactgtttttaacattttgcaattattaattcctctttcaactgcgataataggttacttaacattagatgaaagaataaatatctatcagggaattagcggtattattgtaattattggttgtgtattggcattaaaaagaaaaaacaaggagtgttgatatataaagtagatgatgttggtggaataggtatagttaaatatctggttcaattggttttattaagggcgttagcaattctccatttaagtttatgtttgaattagatattttgggaaaagatggaagaataaagctgttaaataatgctgaaacatatgaactataccaatactcaaataaaaataattctgctggaaatgattataaatctctaattctaacttgtagagaggataatgactatcaatcagaaagaatgattaaagccattaaaaatattattcattgtatgactaataatcatcaacctatttcaagtgctgaaacatctttagaaactattaaaattattcacggaataattaattctgttaaaataggtaatgatcctaacaatatataaggagaataagtatgaaacttaaaactttagccctttctttattagcagctggcgtactagcaggttgtagcagccattcatcaaatatggcgaatacccaaatgaaatcagacaaaatcattattgctcaccgtggtgctagcggttatttaccagagcatacgttagaatctaaagcacttgcgtttgcacaacactcagattatttagagcaagatttagcaatgactaaggatggtcgtttagtggttattcacgatcactttttagatggcttgactgatgttgcgaaaaaattcccatatcgtcaccgtaaagatggtcgttactatgtcatcgactttaccttaaaagaaattcaaagtttagaaatgacagaaaactttgaaaccaaagatggcaaacaagcacaagtttatcctaatcgtttcccactttggaaatcacattttagaattcatacctttgaagatgaaattgaatttatccaaggcttagaaaaatccactggcaaaaaagtagggatttatccagaaatcaaagcaccttggttccaccatcaaaatggtaaagatattgctacagaaacgctcaaagtgttaaaaaaatatggctatgataagaaaaccgatatggtttacttgcaaactttcgattttaatgaattaaaacgtatcaaaacggaattacttccacaaatgggtatggatttgaaattagttcaattaattgcttatacagattggaaagaaacacaagaaaaagacccaaagggttattgggtaaactataattacgattggatgtttaaacctggtgcaatggcagaagtggttaaatatgccgatggtgttggtccaggttggtatatgttagttaataaagaagaatccaaacctgataatattgtgtacactccgttggtaaaagaacttgcacaatataatgtggaagtgcatccttacaccgtgcgtaaagatgcactgcccgagtttttcacagacgtaaatcaaatgtatgatgccttattgaataaatcaggggcaacaggtgtatttactgatttcccagatactggcgtggaattcttaaaaggaataaaataatatccctcacnnccgtgggtaaacatacccacggttaactaggtttctatatcgtagaaactaaaaatctactctaacagagtaacatcataatcaatctaggtgttctaacctagaattcaaataaggaggctatttcaaaacactccgtattcttttttaataaattctcttccctttacttagggaaaacactcttcatttcaaccgcacttctaaggagtgatctatggataaatcattaaaagcgaactgtattggcgagtttttaggtacagccttattgattttctttggtgtgggctgcgttgcagcactaaaagtagcaggcgctagttttggcttgtgggaaatcagcattatgtgggggatgggcgttgcacttgcagtatatgcaacagcgggtttatctggtgcacatctaaaccctgcagtaaccattgccctttggaaatttgcttgctttgatggcaaaaaagtaattccttacatcatttcacaaatgctcggcgcattctttgctgccgcattagtttatgccttataccgcaatgtttttatcgattatgaaacagtccacaatattgttcgtggtacacaagaaagtttaagccttgcgggtacattctccacttatcctcatccaagtttaagcattggtggcgcctttgctgtggaattcgtgattactgcaattcttatggcattaattatggcattaactgacgatggaaacggagtacctcgtggtccgcttgccccattattaatcggtatcttgatagccgttattggtggtgctatgggaccattaactggttttgccatgaatccagcacgtgacttcggaccaaaattctttgcttatctcgctggctggggcgaactcgctttaactggcggacgcgaaatcccttattttatcgttccaatggttgcacctgttttaggtgcattagctggtgcatggttatacaaaaaagcaattggcggcaatttaccttgtaattgcggctgcgaataattatttgaaggagtaatactatgacagacaaaaaatacatcattgcattagaccaaggcacaacaagctctcgcgcagtattattagatcataatgcgaatgtggttgaaattgcacaacgtgaatttacccaaatctaccctcgagctggttgggtagaacataacccaatggaaatttgggcaactcaaagctcaaccttaaacgaagtcgttgcaaaagcgggcattacatctgatgaaatcgctgctatcggtatcaccaaccaacgtgaaaccaccattgtatgggaaaaatcaaccggtacacctgtttacaacgcgatcgtttggcaatgccgccgtactgcagacattaccgataaattaaaagccgatggccatgaagaatatattcgtaataccacaggcttagtggttgacccttacttctctggtacaaaagtaaaatggattttggataacgttgaaggagcacgagaaaaagctgaacgaggcgaattattatttggtaccgttgatacttggcttgtatggaaattgactcaaggccgagtgcacgtaaccgattataccaacgcatctcgtaccatgttatttaacatccatactaaacaatgggatgacaagatgcttgaaatcttgaatattcctcgttcaatgttacctgaagtacgtaattcttctgaaatttacggccaaaccaatatcggtggtaaaggtggtgtgcgtattcctgttgcagggattgctggtgaccaacaagccgctctttacggacatctttgcgtacatgcaggccaagccaaaaacacttacggcacaggttgttttatgttactccacacgggtaacaaagctattacatccaaaaatggactactcacaaccattgcttgtaatgcaaaaggcgaaccagaatatgccttagaaggttctgtatttatcgcgggtgcatcaatccaatggctccgtgatgaactcaaaattgttcacgatagttttgactctgaatactttgcacaaaaagtgactgatagtaatggcgtatatgttgttccagctttcacaggcttaggtgcaccatattgggatccatatgcacgcggtgcgatttttggtctttctcgcggcgcaaaccgtaatcatattgttcgagcaaccttagaatctattgcttaccaaacccgtgatgtcttagaggctatgcaatcagattcgggtgaacgattacaatatctccgtgtagatggtggcgcgacaaacaataacttcttaatgcaattccaagctgacattttagatgtaaatgtagagcgtccagttgtgaaagaagtaacagcgctaggcgcagcttatcttgctggtttagcaacgggcttctggaaagatttagacgagcttcgcgataaagctcgtgtagaacgcaccttcagtccagacagcgacaatgaaaaacgtgaacgtcgctacaaaggctggaaaaaagcagttaaacgctcattagaatgggcaaaagaagatgaagaataatttataaattaattctcatacaaaaagtgcggttaaaaattcttttattttaaccgcacttttttgtataaaawttattttctagagagaggtggaacaaaggttaaacctaaatcccaaggttgctcaatccaagtattttgtggaatatcaattacgtaatcatccactaattccgcacctgcaggttttgcaaatacagtgacaaattttgcattagggtacatttgacgaatggcacgcgctgtattacccgtatcaactaaatcatctaccacgataaatccttcgccgccatttggcacttgggctgcatgaagaacttgtagttctccctgattattgtgatcgtgataacttgcgatacaaacggtttcaatatgacgaagacccaattcacgagccaatacagccgctggaaacaaaccaccgcgactcaccgcaataatacctttccattgggaagctggaagtaaacgttctgataatctgcgggcatgcatttgaaacatatcccaagttaccacatatttttcgctcataattgcaccttagtttaaattttgcgtaaagatgcactacccgcatttttcacagacgtaaatcaaatgtatgatgccttattgaataaatcaggggcaacaggtgtatttactgatttcccagatacttgcgtggaattcttaaaaggaataaaataatttctattataaccgtaggtagtttatttacggttattaatgccatctatgatgaaaaacacttttcaattgaaaagtgtttttcagaaagacttactataccctgaatgaataggaacataatatgaaaacaacgttaaaaatgaccgcacttgcggctctttctgcttttgttttagctggctgtggttcacaccaaatgaaatcagaaggacatgcaaatatgcaattacaacaacaagcggtgcttggattaaactggatgcaagattctggcgaatataaagcattagcttatcaagcgtacaatgcggcaaaagttgcatttgatcacgcaaaagtggcaaaaggtaagaaaaaagcggttgtggctgatttagatgaaactatgttagacaacagcccttatgctggctggcaagttcaaaataacaaaccattcgatggtaaagattggactcgttgggtagacgcacgtcaatctcgtgccgttccgggtgcggtagaatttaataattatgtaaacagccacaacggtaaagtgttctacgtaacaaaccgcaaagacagcactgaaaaatcaggcactatcgatgatatgaaacgcttaggtttcaatggcgtggaagaatctgcattttatttgaaaaaagacaaatcagctaaagcggctcgttttgcagaaattgaaaaacaaggctatgaaatcgtactttatgtaggtgataacttagatgacttcggtaataccgtatatggcaaattaaacgctgaccgccgtgcattcgttgatcaaaaccaaggcaaatttggtaaaactttcatcatgttacctaacgcaaactacggtggctgggaaggcggtttagctgaagggtatttcaaaaaagatacacaaggccaaatcaaagctcgtttagatgcagtacaagcttgggatggtaaataattttccattaaaaagatcgatttaaatatcgattttgaaaatttaattgaggggctaagctcagtttttactggcttagcctttttaatttttcaagttcactcaagtaatcatcattactacagcctgaagttttgctatgatgttgcaagcctttcaaaatagaaatcataagttaatgaagaaaaatttttcagcagggaaattgccgtctaaaggaaaaagtgcggttaattttcaccgcacttttaagccaaaattaaaacccaaaacgttgtcgttggatgaaaccaaagttgtgttattcaataaaccttttgatgtactcacgcaatttaccgacgaacaaggacgcgctaccttaaaagattttatttcaattccaaatgtttatgcggcaggtcgattagatagagacagtgaaggattactgattttaaccaataatggcgaattacaacatcgtttggcagatcccaaatttaaaacagaaaaaacctattgggtgcaagtggaaggtatccctgaagaaaccgatttagcacaactgagaaaaggcgttgaactcaaagatggcgtgacaaaatccgctaaagtgcggttaatttcagagccaaatttatgggaacgcaatccacctatccgagaacggaaaaatattcccacaagctggttagaaattaagattagtgaagggcgcaaccgccaagtgcggagaatgactgcgcatattggtttccccactttacgattagtgagagtgagtatgggcttattatctattaatggattagaaaatggctcatttagattattatcattggatgaaataaaagcgttatttcagaccgtcaaattataaaaatagggcaagtatttagcttgccctaaatttttctcccataaatattgcgcactgagtaaattagcactatccgcaacgcgatgagcttgagcttggtcaatattgaattgctcacttaaccctcaagcggtgctcgctcgaatatctgcaacttggaaatttttttctaggctataaatgacgccttcgcgcaatgcaccgtcagaatagcgcatttgttgaatatgaaaaacgtcaaacactgcacttaaaatcgctaaaccgggtacaaaaacatccacgcggtcttggtttaaaccgttaatatttagctcggtaaaatgcttggcttgtagtgtttgttcaattagagcatttaatcgctcggctgtaatggttccatttggatcgagattagtcgcaatgacttgcgcaacagttttaatcgtccccgatgagccgagcacagattgccaacctaatttgcgatattcaaggcctaaatcttcgattttattgaccgcactttggcgcgcgcgttgaaagttttctggggaaatgatgccatcggtaaaaaattgagtcgcaaaactcacgcatcccatatgtcggctttcagccataagcggcgtgaaatcatcgccgataatcatttctgtcgagccaccaccaatatctataacaagctttctgcctttttctggctgagtatggcatacaccagcgtagatggttttagcttccgtttgcccactaataatattaatgggataggggaaaactttggctgcttgacgtaaaaattcgtcattattcaccgctcttcgtaacgtataagtgccaactacattgacgttttccataggaaaaccttgtaaacgttcagcaaataaggctaagcaattcacgccacgtgtgatggcctcttgattaagcaccgcattttcatctaagccttctgcgagtttaactttttgttttaagcgcgaaagcacttggattgagccgtttacaatacgcgcaacaatcatatgaaagctgtttgagccaagatcaattgcggcaatttcacgtacattgccacgatgtttgggttctaaaatagagtcgttcataacattcctaaaattcaaatttataaagcaaatcaaacacttggtttgtgctagaaacggattgaaaataaagctgtggcattaggcgataacgtaatgtaacttctgctaagccatcaaataaacctacgccatattttatttgtaagcgattggtaatattaccacttaccgtcactttggatttatcgcccacgccagatgtaccaaggtttaagtcttgaataccaaaaacttcgccaatactgcccactaatttaccgctctttgaaatgcctaaaccaattaatgctgcaccaactgatcccgttgaacccacttctccgctgctttctaacgaacgacctgttaataaataagaaagtgcttgatcttgtggtttgcttggttcactgaaaatagtgacttctgggctatcagctatgccaatcactctcacgccagcagtaattttgctgtcttccattgtttcaggattacgaatagcctcaatattcaatgtaggttgtgtcgcttgcccagaaaagctaataagccctttacgaatcagtaaatcttgcccgaaagaagcatagcgacctttggttaaattaatctgaccaaataaacctaaattgcctttatcttgtttcacagaaagtaaaccatcaagattggtttttaagccataggcatcaaggctaacgtctttaccaatattgatgcgtaaatcagagcgaatttccattcctgattttgtttttgcggcaaattcacgtttaatcagttcttctttgctcttgtgcgggccatttaaaataacttcatcttcactcactggctcagcagtatctggcagactgtcaattttaatacgcgcccaaggaatatccactgttccgcttaaattcaattccttcggattggcttttatcgtgatatttggactgaaacgtagcttcgccatagaaggaatatccacgttgaaattatttgcttgcgcatttaattctgttgtccaatgttcaatattcgcccagtttgcacgtccagttaagtttaagtgactatctactgttttgattttcccttgcaatgttgaacggttatcattaaagcgtagagcaatatcgccatcagtaatattgactggcatagattttaatttggtacgaatattacgaatattgaagtcaccatttaataatggtttctctaaatttccaccgaaactcaacttcgatactacctcaccattcactgattcaccgctagtaagtagctgatttgcgatcgacaagtttaatcgttctatcgcaagggttccgccaagttggcgatttttcgcaagatcgtttaaatgaatatcgcctacaattctgccttggttatgcacattgatgtctgtttttaaaaccaaattattattttgaatgtcggcgttaagggttaattttggaatatacaatttaaatgtacggtaatccaatttttgagagaaggctaaatgattgccatctacgttggcggtaaattggaatggtttatccgtaaaccaagccacatttccttgcacttgtaaattgcctttgaggctgttttgttcgataagtttattcactaaatccaaattaacacgtttaaattggaaaggaatattgccttgcttgcctgcattgaatgcttgtgggaaacataattctacatcggtgttttgccagcaatgtgaggcaatattggcttgtgtttgtttgttatcgtaggacaccgcaatcgcttggttggattttacatcgccaatcggagtttcaaattttacctgtgaaattgtgcctttccactgctccaaagtgcggtcaaaatgtccgttaatttgtaaatttgcagcaacaggctcgccttgagattttaggattagtttgtgattttgttcatcgcctgataaatcaagatcaagtaaatggagtttaatatttccgccataatgaagttgttctgctttaatattcaattttccactcgagagtgaggcattgtttatatgaccttttatacttgctttggctaactgaaaaccctgtaaatgtaaattagatgaagttaaatcaagatcaagattaggtgtcgtaatttgaccagaaatcgctactcgaccttttactcgcccttttaaatctgaccataatccacgtaaatttggcgcatttatatctagcgcaaaatcagaatgatcatctaatacgccactggctttaagataattttcgccatatttaatctgtaaatcaggcactgttagaagtacattttgattgagcgttgcagaaccttttaaactgataggttttgcagaaagcattccgtttaaatcggctactggcacttctacttgccatccttgagagcctgcaaaaccacgtgaatgcaatttaccagatagtgttgcaggcattacaggaacaaaaaaagcaatattcattttttctaaatcggcttgaatatcccagtttgcaccatttttccaattcgcattacccacaaattcacttttaccgtctaatgaatctatccccaatttattgacggtgacttcataaagtttgccgtcggcattaagttccacttgagatgcgggaatataattcattcctgctacatcgcccttaagttcagcgtgataatttagtaaatcccctgtgagtttaagcgtcacatcattaattttgagtggcgtcattgtgtttacaaaagtgtattgtccttttgccacatttaatgtgaggtttaagggcattttgtcttgtgctaattgcacgttgccattcagttcagcatctaacacgccttttgttttcaaagaaagtgcggtggattttttcaatgatcccgaaagcgtaagatccacatcactcgcgggcagaatttcttttccatcggatttcaatggctccaaatgggattttaaagttaaatcgagaggcatatcgccatcgagttgtaatttaccttgtgaagaaagattacccaacgagctttctaccgctaatttttgtaattgcagttggttatcgacggtatccgcctgtgcaattaaactagacatttcaacagattgaagcgtttcgcctttttcattcactgcttgatactgccagtttttgcctgaaatttcaggaatatgtaaatcaaaaggaagaatgatttctgatacattgcctaaaaaagcaggcgttaaagattgctcaatcgcagcccaatctacaggcttattcggctgttcggctttcggctctgatttaacttcagacaatttttttgcaatcactgaaatatcgttaatttcagtcggcgcaatagttaagcctttttcattatttaaacttaccgcacttttaaaatttccaagcgtaatactagtctgatcaatgtttacagataaatcttgcatcaccaaattttctgcattgatactaattggcaaggaaatacgcttcattgagccagactttgaattatcaggtgccgatggaggcaataatgcagtattaatcgcaatcgtcggtttatttaaggtgaagtctcgtaaacaaacttcacgtgaaaacaaacaaccaaaatcgagctgaaacgtgcttgtgcaatatgtgtctcaatcccagcggtttgataacgaacattctttaacaccaagccattttgtaatccgccttcaacttgctcaacggaaaaactatcaagcattttatcgacaagttgaattaaacttttttgccctgcatcgaaagaaagtgccccagcaacacctaaaacaggcaccaaaatgaccgcacttccgatacaaacagccttgcgtacccaatgttttttattaggtttctcaggtgattttggtgaagtttctgatggttgtatttgttctgtcataaattcaccttaaatttctgtaccaagtccgatgtaaaattgaatatttttgctgttatctttatcacgaatgggtgtggcaatatcaaatttaatcgcaccaactggcgatgcccaacgcacaccaacgcctgtgccataacgcagctcttttgctgtgtaattatcggcagctaatccactatctgcaaaagttgccgcccaccaatttggatagacttgatattgatattctaaagaagtggtaagcaatcgcgaaccacccaccaattttccatttctatttttaggcgcaatttttttatagccgtaaccgcgcacactacgatcgccaccagcaaagaaacgcagtgtaggcggaattttttcaataccttttgtatgtaaatacccgatttcagcacgagcaacgacacgatgattttctgcataagtacgaacccacgcgctagatgcttgcacttttataaaagaagattctgatagccaaattcgtttgcttaaatcaaaagtaattttttgcacatcgccccaagtggcaaaggaaccaccacgtaatcgagtacgagtaaatccaacagttggataaagaagtaaggttttatcagtgatatccgcttgtgtaaaactgtcgtatcgcatacgaagtccgccaaaatattgccaaccatgcgcattattccaataacgtaacgctgacaacgtaagcactctcgtattggtatcattctctttttccccttcccaaccgacgggcaaaatcatagtaataatttaatggatttttaagcagtggcattcgataagttgcctctagagtttgttttggtgcagagagataaagatttgaacgcaaactatgtccacggctattaatccaaggttttgtccagcctatttgtccgtgaacgccgccatcagtagaaaagcccacaccgagttccatcgcattttttttacgtggataaagaataatctccacatccacagttttgcttttatgattaacattaggctgaactaatactgagctaaaccaatttgaagatggaaaatcgctggttaaatccgacaaattattcattaaatacggatcaccagatttgatgttaagaatattatttaagtaatcatcccgaatttgtgaatggctaaaagtaatattgccataatgataacggacaccactatcaaataacattcgccaccatgcttgatgggtttcagggctgatttctaaacgtgaaattttaaagttcccatcaaaatacccacgatttaatgctaaacgtgaaatcgctgttttgtaatcatcgtaagtttggtgctcaaccaaaacgccatctttcggtaagtttttacgcaatgcattaaaattttcatcttgtgcggcttccccctcaatttggcacatcagtccccgcaatttttgttggctcgcctggtgtaacatgagcaatcaataaatcgcgtttgccttgacgctgttttcgttcaaaacgcacggaagattcataataaccaaacacacgcaaaccacgatccacggctttggttaccaaatgttgatagcgttcggagccatccatttcttctttattaatcaaattaacattgagatctgtattacgcacagcacggaaaccacgaatgccttgaacttcaatatcaacggtttgttcagcaaatgcgggaaagcaacttaatgctaaaaaaagtgcggtgagttttagcgattttttcttcattttaaggggttaaaattttctaagtaaattgcactatagtctaccgagaagttcgttaggatccaatattttcagtgcattttgtcggttttttcataaaaaataccgcacttcattgccaaagtgcggtaaatttttgagctgttttaattagtgaccgccgcaaccacagctgccgtgattatgttcgtgattatgttcgtgatgatgaccaccacagccacaaccgtgaccttcttcgtcatcatcgtggctgtgcgcaccgtgaacgtggccgtgagcaatttcttctaacgttgcttcacgcgctgcaacaacctcaacggtgaagtgtaattcttgccccgctaacatatggtttccatcaactacaacttcatcgccatcgatttcagtaatcaccactggaactgggccaatgtcagtatccgctaagaaacgcataccgacttcaagttcatcaacaccttggaatacatcttttggtacacgttgaaccatattttcgctgtatgcgccgtaaccttcttcaggttgtacacgtacttcaaatttgtcgccaacttctttaccttcaagtgctttttcaagaccaatcactaaattattgtgaccttgtaaatattcgagtggttgatttgctggagcttcatctaccaatacgccatcttgtgtgcgaacttggtaagaaatgctcaccactacatttttttctactttcattatgttttccttataaaaaatccgttaaaaaagtcgtaccattgtagcgaaaattattccgcgcgcaagactttacggattaatgaacacgaggctcttcttcatcttcatcatcaaaaaattccccatcgtcaccgtattcatcttcatcatcaagaaattccccatcgtcaccgtattcatcgtcatcggcatttgggtcttcaaaataagttccccaaccgtcgtaaataccattatgtttttctaataacggaaggatttctttttgttgagcatcaataatttcagcttttaattctacttcactgatgatgtcaaaacagaaaattggtttaccgtcatcatctttaaattcttccgcttcggaaacttcatagcccgctttaaacgcatcaaccgcaattttttctaacaaatcaaaatcgtggtgtgcaatgtgatgctcaataatgtaaagcgcatttggttcactgccatcattaagtaaatcttcgataatttcacgggtttctgcttgtaattcagctaattttgacataataaaatccttcaacaagaacaaaagtgcggttattttagtggataaatcacgaaaagtcgcatagaatttcgcacaattattttcgataaaaaagagcccttaactatgctcgaacaactcccttatttagcattaaaaactccgccaaaaaccaccgcacttttaaaggctgaatgtgcggattttattgtaaaagagcatttaggctatgaaatgtcaggtgacggtgagtttgttgcgttgtatgtacgcaaaacagattgcaacaccttatttgttggcgaaaaattagctaaatttgctggtgtttctgaacgcaatatgggatatgcagggttgaaagatcgtcgagcggtgacagaacaatggttttgcttgcaaatgccaggaatggaaacgcccgatttcagtcaatttgaattagatggcgtagagattttaacggttactcgacataaccgaaaaattcgcacgggtagccttgaaggaaattatttcgatattttattacgcggtgcagaagaatctgatgagcttaaagcgcggctggattttgtggcaaattttggtttccccaattattttacggaacaacgttttggtcgggatggccataacctcacgcaagccttgcgttgggctcaaggggaaatcaaggtaaaagatcgcaaaaaacgcagtttttatctttccgccgcgcgcagtgaaatttttaatttagttgtggctgcgcgtatcgaaaagagcacaataaatcaagttttaccaaatgatattgtgcaattagcaggttcgcacagttggttcaaagcggatgaaaaagaagacttaactgccttacaagtgcggttagaaaatcaagatattttgcttactgcccctttaattggcgaagatattttagcagcaagcgagattgaaaatgaaatcgtaaatcaacattcagctttcgatcctttaatgaaacaagaaagaatgaaggctgcacgtcgcccattattgatgaaagcaaaagggttttcttgggcatttgagccagaaggcttgcgtttaaaattttatttgccagcaggcagttatgccacggcattagttcgtgagttagtaaattacacagaagaataaggaaatataatgcgaattttagttagtaatgatgatggttttcacgcggaaggcattcaggttttagcaacagaattaagaaaaattgcagaagtcattattgttgcacccgatcgtaatcgaagtgcagcatcaagctcgctcacattggttgagccattgcgcccacgccatttagataatggcgattattgtgtaaatggcacacctgcagattgcgtacatttagcgttaaatggatttttatctggtcaagtggatttagtggtatcaggtattaatgcaggttgtaatatgggcgatgatacgatttattcaggcacattagctgcagcccttgaaggtcgtcatttaggtttgcctgctattgcggtttcgttagatggtcgtcagcattatgaaactgcagcacgagtggtatgtgatctcattccaaaattacagcatcaattattaaaccctcgtgaaattattaacatcaatgtaccagacttaccttttgaagaattaaaaggttacaaggtgtgtcgcttaggttatcgttcatcttccgttgaagtcattaaacaaagggatcctcgtgatgaaaccatttattggattggcccttcagcattacccgaagatgaaagcgaaggaacagatttttatgccgtgaagaatggttatgtgtctatcacaccaattcaagcggatcttaccgcatatcattcattgctttctttgcaaaattggttagatcaggaatttaccaaatagagaaaaatatgaaaattttcggcacgatgtacgataaaacgatggaatggtcaaaacatcgttttgctgttttttggctctcttttgtaagttttatcgaggcgatattttttcctattccgcccgatgtgatgctgatcccaatgtctatgtcaaagccaaaaagtgcggtgaaatttgcattttatacggcaattgcgtctgtaatcggcggaattatcggttatgctattggtttttatgcaacggactgggtggaaaacattgtgcaacaatggggatatgctgcgcattgggcaaaagccgtcagttggtttgagcaatggggcgtattagttgtgtttgtggcgggttttagcccaattccttacaaggtgtttacgctctgcgctggagtaatgcaaatggcatttttcccttttgttatcaccgcatttgtttcacgtttagcgcgtttcttgctagtagcaaaattagctgcatggggcggtgaaaaattcgcagcaaaattgcgaaaatctattgagattattggctggtcagtggttgtactggctgtaatcgcttattttatactgaaaaattaggatagaaaatgaacaaattaagtcttgttttagtagctggatttcttttggttggatgtgcatctgaatcagttaaagatccagacgcattaccaaatggcattatgcaaccagtagaaggcactggtgccgttgctggcggtagttttatgccagaaattcaaaaaaatacgataccaacacaaatgaaataataacggaacaataaggaataactatgaaaaaatcgtttctcttactccctttgagtcttgttgtattatcggcttgtacctctaattttcctgcacctatttctgatgcagatggaaatttttcccctagtgtaatacaatctgtaaatggcagtaatgtaggtggtgcttggcaacctgaaattcaaaaaaattcattacctacaacgggaaatatggtcacgccacaacaaaattttcaaccgattaatcaacaaccaacaatgccaacagcacctgcacaacctgcatttcaaccctctccgaaaaccgtagttagtgcaccgacagtacaaacaaaaacagttaccaaaacagtcgctgattgtgtagatggacagcatattaatatcccacgtaatccaaataccaatgcgccagattacagcaaaatctcaaaaggctcttacaaaggcaatacctataaagtaaacaaaggcgatacaatgttcttaatcgcttacttggcggggattgatgtaaaagaattggcggcgttgaataacctatccgaaccttataatttaagtttagggcaagttttaaagatttctaattgtgacataaaaacggttactacaacggtttctgtaaaacaacctgcagtcacagcatcaacagcaacgccagttaaaccagcagtcacttatactccgggcgcaaacggtactcaaataggatctgacggtactattattggcccaattaaatcagaggctggcacatcgcctagtgtacctgtggcaacttcatcaacacaggttacatcatctgtaaataatgcgaatagcacaccaattaattccaatgtcgttgcgccaatcgcctcaaatgttgtgtggcaatggccgacttcaggtaatatcatccaaggtttctcaagcacagatggcggtaacaaaggaattgatattagtggttcacgaggacaagctgtaaaagcggctgcagcagggcgaatagtgtatgcaggcaatgctttacgtggttacggtaatttaattatcatcaaacataatgatgattttttaagtgcctatgcgcataacgacaaaattcttgtcgccgatcaacaagaagtcaaagcaggtcaagacatcgcaaaaatgggtagctctggtacaaataccgtgaaactccactttgaaattcgctataaaggtaaatcagtggatccagtacgttacctaccaagacattaatcttcctgtaaaaagtgcggtaaaaaatctcaacaaatttttaccgcacttttatctggctttttcccctttcggcacctaaaatagccgccacaaaacctatctttattcagtttcaaagcaggtaattagatgatttccgaagaaaatttccaacaacatacgccaatgatgcagcaatatctaaaactcaaagcggagaatccagatattttgttgttttatcgcatgggggatttttacgagttgttttatgacgatgcgaaaaaagcggcggcattgttggatatttctttgacgaaacgaggtcaatctgcaggacagcccattccgatggcaggaatgccttatcatgcagtggaaggttatttagcaaaattagtgcagttaggcgaatctgtggcgatttgcgaacagattggcgatccaacgacgagtaaaggaccagtggaacgtcaaattgtgcgaattgttacacctgggacagtaagcgatgaagcgcttttgcctgaacgccaagacaatctgattgctgcggtatatcaagagaaagaaaaatttggattagccactttagatatgacctctggccgttttcagctttgtgaacctgcggacaaagaaactttgcgtgcggaattgcaacgtattgcacctgtggaattgctttattgtgaagaatttaatgaaatggctgcgattgaacattgtaagggattacgccgtcgcccgatttgggaatttgaacttagcaccgccattacgttattaaatcgtcaatttggcacaaaagatttacgtgcctttggtgtggaaaaatcccctctaggcttaagtgcggctggttgtttattgcaatatgcaaaagaaacgcaacgtaccgcattaccccatattcaaagcattagcttgattcaaaatcaagactgcattcagttagatgccgccacgcgcagaaatcttgaattaacacaaaatcttgcaggtggcacagaaaatacgctagcgtctgtattggataaatgcgtcacgccaatgggcagtcgcttattgaaacgttggattcatcagcctgttcgtgatgtggaaaaattaaaacaacgccaacaatcgattgcggaaattctgaattttgatttagtcgatgaacttcagccttatttgcaattagtcggtgatatggagcgtattttggcacgtgttgcgctacgttcagcacgtcctcgcgatctcactcgcttacgcacggcgttagaacaaattccagcattacgcgcgattgtgcaacaaaaaacaccgccatttttaaccgcacttttcagccaaattgctgatttcagcgagcagtgcgatttattgcaacgtgcattgattgaaacgcctccgcttttaatccgtgatggtggcgtgattgctgaaggatacaatgcagagttagacgaatggcgtatgctctctgatggtgcaactcaatatttggaaaacctagaaaaacgtgagcgtgaaagcacaggcattgatacgctaaaaatcggttttaatgcagtgcatggttattacattcaaattagccaaggccaagcacataaagcacctattcattatgttcgccgtcaaaccttgaaaaatgcagagcgttatattattcccgaactcaaagaatatgaagacaaagtgctgaaatcaaaaggcgcagcgttagcattagaaaagcaactttacgatgaattatttgatttattattaccgcacttaggttcattgcaactggcgagcctcgcactttctgaattggatgtattggtcaatcttgccgagcgcgcagacaccctcaattacgtgatgccaacattctgtgatgaagtgagtgtgaaaattaaaaatggtcgccatcctgttgtggaacaagtattgaaagatcctttcatcgccaacccagtggaactcaatcacaatcgtcatttattagttatcactgggccaaatatgggcggtaaaagcacttatatgcgccagaccgcattaattacattgctggcgtatatcggcagttttgtgccagcagacagcgcgcgaattgggccgattgatcgtattttcactcgaattggtgcgtctgatgatttagcctcggggcgttcaacctttatggtggaaatgacggaaatggcaaatattcttcatcaagctacagcgcaaagtctcgtgcttattgatgaaattggtcgtggtacatccacttatgatggcttatccttagcttgggcttgtgcggaatggttatccaaaaaaatccgctcgcttacattatttgccacccattattttgaattaaccgcattgccagaacagctagaaggcattgccaatattcatttagatgcccttgagcataacaacaccatcgcctttatgcacgccgtacaaaatggcgcagcaagtaaaagttatggtttggcagtcgcggctttggcaggcgtgccacaatccgtcattaaactagcaaagcagaaattgacacaattagaaaaaaactcaagctattcagccgaacagcaaattcaagcgttgcgtgaagccaatcacaatcagggcgaattattctttgaacaagaaacggatgcactaagagaggctattgaaaagctggatcctgatgatttaagccctaaacaagccttggcgtatttgtatcagttaaagaaaatggtggggtaaatattatatcccagcgataaattcaaaggtttatatggattggcggaggggaatgggagttgaacccacccaagaacgctggcgtcctcaacaggatttgaaatcctgccacctcaccggagatgacgcccctccgtggttgaaattgcggtcactttagcgtaaattaattggcaattcaacgttattttaaacggattcaaaaatgaccgcactttttcaacaacttccttccgttgataaaattctcaaaacacctcaaggcttacaactcattaccgaatttggtcacactgcagtcgtggcaacatgtcgagaattattaacccaagctcgtcaatttataaaaaaaaacaatcaacttcctgaatatttttctaattttgaccgcacttttttagaaattcattctcacttacaaaaacaaaaccaagtacaaatcaaagcggtgcacaatctgactggcactgtgttacacacaaatcttgggcgggcactttggtctgaagcagcacaacaggcagcgctttctgcgatgcaaaaaaatgtttcacttgaatatgatttagatgaaggtaagcgtagtcatcgcgataattacatcagtgaattattatgcaaactcacaggtgcggaagcagcctgtattgtgaataacaacgccgccgcagtattattaatgttagcgacctttgctcaaggtaaagaagtaattatttctcgtggcgaattaattgaaattggtggtgcatttcgtattccagatattatggaacaagctggatgccatttagtggaagtgggcaccactaatcgcactcacctgaaagattatcgtaatgctatcactgaaaatacggcttttttaatgaaagtgcatagcagcaattatcaaatttgtggttttacctcttcagtttcagaagaagaactcaccgaactaggtcaagaaatgaatgtacctgtagtcactgatttaggcagcggcgcattagttgatttaagccaatatggcttaccaaaagaaccaaccgtgcaagaaaaaatcgcacaaggtgtggatttggtctctttctctggcgataaattacttggtggcgtgcaagcaggcattattgtgggtaaaaaagaatggatcgaacaattacaagcccatcctctcaagcgtgtattacgttgcgataaagtcattttagctggcttagaagccacattacgtttgtatttaaatcctgaaaaactaaccgaaaagttaccaactttgcgcttactcacgcaaccattaaaacaactcaaaataaatgctatgcgtctcaaagagcggttagaatctcgcttaaattcacaatttgagcttcaaattgaagctagtcaagcacaaatcggtagtggctcacaaccaatggaaagaatcccttccgtggctgttacgattgcagaaaaaacaaacgcaaaactttccgcactttcagctcgctttaaacaactttcccaacctattattgggcgaatggaaaacggaaaaatttggctagatttacgtagcctcgcggatattgaaacattattaaatacattggacgaactatgattattgttacttcaggtcacgttgatcacggcaaaacagcattattaaaagcattaactggcacaagtaccgcacatttaccagaagaaaaaaaacgcggaatgaccattgatttgggatatgcctatctgcctttagaaaacaaagtacttggctttattgatgtacctgggcacgaaaaattcttatcaaatatgctggcaggtttaggtggcgtgcattatgcaatgttaattgtggctgcggatgaaggcgttgcggtgcaaacaaaagaacatttagcaatattacgccaacttcaattccacgaaattattgttgtcatcacaaaagcagatcgtacaaattcagcgcaaatagaatcgttaatccaaacaattaaacaagattatagttttttacgcaatgctaactacttcgttacctcagcagaaacgggacaaggaattagtgaattacgtcattacttagctaatttggcagaattagctgatactcagaaacctttccgctatgcaatagaccgagtattcagcgtaaaaggggcgggtactgtagtaacaggcacagccttttcaggaacagtgaaagtaaacgatgaaatttacctttccactggacagaaaattcgtataaaagcgattcacgcacaaaatacatcaagcgaacaaggtattgcagggcaacgtttagcgttaaatttaaatgctgatttagaccgcacgccaatgaaacgaggcgattggttattgcagaatgagccacttccaccaacagatcgcatcagtgtacaaattttggctgaagtaccattaaatgaaagccagcctgtgcatatttatcacggagcgagtcgcactacgggtaagctcaccttattacagggaaaaaatgccgctaaaaatgaccgcactttagctgaaatcatattagattcaccattattcttggctttcggagacaaacttattttacgcagtggcgatacaaaaaccttaattgccggcgcacgagtattggaaattaactcgccaaaacgtcataaacgaactgaagtgcggttaaatttcttagccaatttagcattggcagagaatgcttcgcaacgtattgcgcttacccttcaacataatgcgacaacggcacgccaattaatgtggacggaacaactgacttccttgcaattagataaagcactcgccgagcgggacgctgtacgttatcaagattggtgttttaatcctaattacgtacaagaaaaaacgcagcaaattttaaccgcacttaatatctatcacgagcaacataatgatcaacttggtgtaagcaaagccagattatatcgaatggcaacattgaatcagccagaaaactaattcatcattttatcgatgaaatgcttgatgatggacgattacaacaaacgcgtggctggattcatctaccagagcacaaaattcagtttaatactgaagaaaaatcacgttggacagatgtattaaacgagtttgaaaaagcaaacggtcaagcgatttgggtgcgcgatatggcaaatgcactcgctattgatgaatcaattatgcgtaattttatgtataaagcagggaaacttggttacctcacgccaatcgtaaaagatagatttttcttaactgaaaccctctatgcttatgcaagactcatcaaacaaatcgcagaagaaaaaggaaaagtttcagtaaatgaagtacgtgataaattgaatttcgggcgcaaacttaccgttcaactgatggaatatttcgaccgaatgggttttttacgtcgtaaaggcaatgaccatattctacgcgataagaatgtttttgatttatgatgtttatgaaatcgccccttacgcagcaggagagcaggatttgttgctctattttgggcaactagaagagttatttaaaccagaatttagacagggtaatgatatttaaatcctttaacttttgaatagcaatcaaaatccctaattacattaaaaatgagagactatagattttgcacttcatttttattacaatagtctttcaatgtaatactaaggagaaaattatggcacttactaattcctctatcagttttagaacagttgagaaaacaaaattagaagcttatcaagttattgaacaatatggacttaccccatcacaagtattcaatatgtttttggctcaaattgccaagactcgctctatccctgttgatttgaattatcttcgcccaaataaagaaaccctagcagctattgatgaattagatagtggtaacgcagagagcttctttattgaagctagtgaaaattattctgccgaagaatttacaaaacgcattcttaatggtggtcaataatgtcagaagagaagccattaaaagtgagctattcaaaacaatttgtaagagatttaactgatttagctaaacgttcccccaatgtgttaattggctcaaaatacattactgcaatacactgtttattaaatcgtttacctttacccgaaaactaccaagatcacgcattagtaggagagtggaaaggttatcgagattgccatattcaaggtgatttggtactgatttaccaatacgttatacaggatgaatttgatgaattgaaattttctcgtttaaatatacactcacaaaccgctttaaaatagaaataatcttaaacaataatccgcacgtaaaatgtgcggattatttttacatagcattaaaactcaaactgaacagacattctgtaatttctgcctggtgcataaaagcggtttaagcctttacctgttgctgtttctactcggttaatggtgccaagatgtcgaatagagcgagcagagtcccaagtgagatattttttattggttaaattatatacaccagcggtaaatgtaagatttttaattggtttccaataggcaatcgtatcgatcactgtatagcgattattacgccataatccgcgagaatcttttacttctttgccgtttgctgttgatgcttccgcatctttttcattgccataaatcttttcttttcgtttaaccatacttgtccattgagaattaaagctatcttttgcttttttggctgcaacattagtgatatacatatccacgccccatttttggcttggtgcatcatagccaatattatataccgatgtggttggttgtaaggcattcattggttgaggtttacgagcaatggcttcgtattctggatgtttatctttattcaattccaaaaattctttatattttggatttaatccattgtctttaattctgcctttttgataggtaaatttatagcctaaatggaaaccttgtagtttttcaaataaatcgcccatctcaagacgtgaagcaatttcgatacctctgactcttgctcgatctcgattttggttctgatggaacggataagcgatagtagagccttcttcaataggacgtggtcctacttctactaagtcaataaaattacggtaatcgttttggaatgcatttaacgtaatataactgctgtttttataaaaagtgaacgcgacttcttttgttttagaggtttccgcttttaaatccgtgttaggctgaatggaaaattgcggatgtttaaatgtcatataaatttcatcagaggttggcgcacgaaaaccattggcgtatttaagctgtacacgaagccaatctgtgggatcaagatttaaccctaaattgtaagaatgatgtttatagtcagttttgcgtaataacagggcaagattgtctttaaaattttttttataacaatctgaattgtaagtgcaatcagtatagtctgcaggcttcgaatatttactgccataaacatagtcttttgggccaaatttcttaaatagcccagtaattaatccattaggaactggaattttttcgtcataactaggcaaatattttacgtggtcatagcgataatttaaatctagccctaaccaagaggtaagttgcacattatctccaaaatacaacacattatttttagtggtaacagggattaaataggtctctttgcctttatcagtattcattaagctacatctgtgactataatcaggtgcaggagtacgcttaccattttcaagtttgttacagaaaaaattgccagcccaccattgcacattggcaacagtgttgtattgatgattcaccatactttttagtgttttttcataaaaaccaccatattttaaactgtgttgggtatgccaaaggctaaattctttatctaaatcaagtttaatttgttgggtgttggtatttaaatcacgatcattgacgaagtctgtactatagccatagctttttgggaataaaaaacgtgcggattcttcttgataaacatcatcccatagtggcgtctttccctttttcagtgtaatttttccatattttttaccattcggtaatgtttcaactatgatatctcgctcttcatactcgtatttatccttcccctcttcatctttttcaacaaaaacctgaaatttgtttttacaatttaatctttcgcaatcaattaagaccgaatcaagtgagcctccagtggaatcaatatcgttatcaacattttcaccattcttattctgaaattgaccataccagccagcgtttttgttgtatgtaagtttatccccatttttatccacaattttataaactccgccttcttctactaaatgtagcccttgtggattacttacaccattacaagtggattgatgacaatactcatcagaacgtgctttattggtgattttttgtgaagaataacttagtttaatatgatcccaaaaaggggtttgactgaaattttcataactaaattgaatattttttcgtttggattgatcgttaataatacgctcaccgtatttttcattgccagctgtactatatggtctaagagcgtaagacaaatctataccctttgtttctaaagtagaatcatctaatgccacactcaagcgatggttttcattaggctgaaagcccagttttattaatgtgctttggcgggtaatttgataaggatcggctttttcacgggtaggaccaaccgctcttaaatccgcctgtttgttgggataaattttataatcgtagttttctatttcgtgcccatcacgcgttgtatcaatgattaaaatatcaaattttttagaacgtcctgctaatgtaagtgtcttaaggttttgattattcattgtttgatagccacgtttataggaaagataataatctttatctatcagataatctcgagcatcttttgtttcaaatataacagagccacccaatgcgccactaccagattttaaggagtcagcacctttggtaatagttgctgttttaacattttcaatttcaatgctattacgagtattattaaaattgccatagccttcaaatagctctttaaatccttgagagcttaaggtttcagcttgacgaagcccatcaaccataatacctacgcggttttcatcaacccctcgaacggcataaccacttgcgcctgttctaccagtttcaactaccgtaatacctgtttcatagcgaacgagatcacgagaatcagaggcctgctgtttcgctaattttttggctgaaatttgggtttccccgacttttttctctttgatattaatattttctgatgaacctgaaacattaatttgttctaattgttcagaaacattactattttggttggttggttggttggttggttggttggttggttggttggttggttggttggttggttggttggttggttggttggttggttggttggttggttggttggttggttggttggttggttggttggttggttggttggttggttgggctgcatagactgtgcttgcatttaatgcaaatgcaatagagcaagcaagcaggctgaatttaaagttggtcataggtttccttaatttttaatgataataattattatacatattaaataattcaatttatttaatcaatatcaaaaaaaagtataataagtacaaaatctaattgctttatatgagcataaaagaaaatcatttttgaccgcacttttgtttgtaagtcatattttaaaattatcaaaatgcaatttttaatcactcttttatcgactgcgtagatttctttcgttataattgagcgtctttttatttaacaaacgtgttcggtgtggattttgaccgagtgcaaattaattgaggtaacaaatgtcattaaatattgaaacaactcaaggtttagaacgccgcgtagcgattaccgttccaactgaaattgtctctaaagccgttcgtgaagaatttaaacgtgctgcaaaaaatgtgcgcgtagatggtttccgtaaaggtcatgttcctgcccatatcattgaacaacgttttggtgcgtcaattcgtcaagatgtattaaacgatttattaccacgtcatttttttaatgctgttattgcagaaaaaattaatattgcaggtcgtccaacttttgctattgaaacttttgaagaaggtaaagacttagttttcactgcaactttcgaggtttatccagaagttaaattacaaggtttagaaaatatcaaagttgaaaaaccaactgttgaaatcacggaagctgacattgataaaatgatcgatgtgttacgtaaacaacaagctacttgggctgaaagtcaagatgttgtaaaagcagatgatcgtgtcactattgattttgttggctctgtagatggcgaagaatttgaaggtggtaaagctactgactttgtattatttatgggtcaaggtcgtatgattccaggttttgaagaaggaattgttggtcataaagcaggtgagcaatttgatattgatgtgactttcccagcggaataccacgcagaaaacttgaaaggtaaagcagcaaaatttgcgatcactttgaaaaaaatcgaaaatatggtgttgcctgaattaacagatgaatttgttgctaaatttggccctaatactaagtctgttgctgatttgcgtgcagaaatccgtaaaaatatggaacgtgaattgaaaaatgcgttagtttctcgtgttaaacaacaagtaatcaatggtttaattgaacaaaatccgattgatgtaccagtttctgcagtagaagaagaaattaatgtattacgcaatcaagcagctcaacgttttggcggtaatgcacaacaaactgcacagttaccgcgtgaattatttgaagctgaagcaactcgtcgtgtacaagtgggtttattattctctgaagtgattaaatctaatgaattaaaagctgatgaagaacgcgctaaagcaatgattgcagatattgcatcagcttacgagcagccagcagaagttgtggaatattacagcaaaaacgaagagttaatgaataatattcgcaatgtagtattggaagaacaagctgttgatgcagtacttgcaaaagcacaagtaacagaaaaagtttcttcattcgatgaaattatgaatccacaagcataataagtaatattattatgattgantaaaagtgcggtcgctctttttaataaaagcgatcgcatttttatttgtgggttatttacgataaaataattagcagttttaatgaaaaaggtaagaaaatgagtgtaattcctatggtcgttgaacagacttcgcgtggcgaacgttcgtacgacatttattcccgtttattaaaagaacgtgtgattttcctaagtggagaagtggaagatcgtatggcaaatttaattgtggcacagcttctttttttagaatcggaagatccaactaaagatattaatatttatattaactctccaggcggttctgtgaccgcaggtatggcaatttacgacacaatgcaatttattaagccagatattcgcactctttgtattggtcaggcttgttcaatgggcgcattcttacttgctggcggaaccgctggcaaacgagctgcgttacccaatgcgcgagtgatgatccatcaacctttgggtggtttccgtggtcaagcatcagatattcaaattcacgcacaagaaattttgaaaattaaacacaccttaaatgatcgtttagcattccatactggacaaggtattgagcgtattgagaaagatactgaccgtgataattttatgtcagctgaagaagcacaagcgtatggtttggtggatgaagtcttggttaaacgttaagggtatataatgacagacaaagataaagatttgcactgctctttttgcggaaaggaaaaaggcgaagtagatagattaattgctggcacagacggttatatttgtaatgaatgtattgaactttgtcactcaatgcttgaagaaagtcatgataaaaatttagaggaaagtgcggtagaaaatgaagaaaaattaccaacacctcacgaaattcgcgctcatctagatgattatgttatcggtcaagattatgcgaaaaaagtgctttctgtggcagtttataatcattataaacgcttgcgaactaactatgaaagcaatgatgtagagcttggtaaaagtaatattttacttataggccctacaggtagcggaaaaacgttacttgcgcaaacattagctcgtcgtttaaatgtaccctttgcgatggcggatgcaaccacattaacggaagctggttatgtgggggaagatgtggagaatgtgttacagaaacttttgcaaaattgtgaatacgatactgaaaaagcagagaaaggcattatttatattgatgaaattgataaaattagccgtaaatcggaaggcgcatcaattactcgagatgtttcaggagagggggtgcaacaggctttattaaaacttattgaaggtacaatcgcttccattccacctcaaggcggtcgtaaacatccacaacaagaaatggtaaaattggatacgtctaaaattctctttatttgcggcggtgcatttgcaggattagataaaattattgataaacgcactcaaaccagtacgagtattggttttaatgccaaagttgaaaaagatgaaaaacaacaatctctttctgaattattccgtcaagttgaacctgatgatttaatgaaatttggtttaattccagaatttattggacgcttgccaatgattgctccattaagtgaattagacgaagatgcgctgatacaaattctcacaaaaccaaaaaacgcattaattaaacaatatcaagccttatttggattggaaaaagtagaattggatttcacaccagaagcattaaaagcaatggcgaaaaaagcacttgaaagaaaaacgggtgcgcgtggcttacgttctatcgtagaagcagtgttgttagatacaatgtatgatctaccgtctcttgagaatttacaaaaagttatcgttgatgaatcgacaattgtagataatcttgcaccaaaattagaatattagatttaatcgcaaaagtgcggttgttttcaccagattttctatgttgatgctattttcaataggcaaggcgaaaagaaaatgctacaatcgcaggttcttatggcattatttttacatttccatttaaaacggattcaattctatggcaaccgaaattgttgataaaaagaaaaatacgcaagaagtgatcgtgaaggcaagtctaaaggtttaaatacattcctttgggttttagttgtgatcttttttgctgctgcggcaattgggaatatttatttccaacaaatctattctttaccgattcgtgttattggtatggctattgcattagtcattgcatttattttagcggcaattactaatcaaggaacaaaagcacgtgcgttctttaatgactctcgtacagaagcgcgtaaagtcgtatggccaacccgtgctgaagcgcgtcaaacaacattgatcgttatcggggtaacaatgattgcttctctcttcttttgggcagtagattcgattattgtgacagtgattaatttcttaactgatttgagattctaaaatgactgaagaaacaacagtatcaaaaaaacgttggtatgtattacaagcgttttctggctttgaaagtcgtgtagctctaactttacgtgaatacatcaaacaacaacaaatggaagatcaatttggtgaagttttagtaccaactgaagaagtagtggaaaatgtagcaggtaaacgtcgcaaaagtgaacgtaaattttttccaggttatgtacttgtagaaatggaaatgaatgatgaaacttggcatttagtaaaaagtgtgccaagagtgatgggttttatcggtggtacaccagataaacctgcacctatttccaaacgtgaagcggatactattttaaatcgtcttgaacaaaatactgataaacctcgtcatcgtaatgaatatcatccgggagaggaagttcgtgtgactgaagggccatttgctgattttaatggtacagtagaagaagtggattatgaaaaaggccgcttaaaagtgtctgtatcaatgtttggccgtgctacaccagttgagcttgaatttggtcaagttgaaaaaatacactaagaaatgattaaaatataaccgcacttttgtagtgcggttttttgtttttaatgtttgttgaaacagcataaaagagtgtttttatacacaaaatttgttgttatttcacaaattaggtagaataatcccatatttatgtaaggattaaaaatgaaaacaaagacaattttgaccgcacttttgagtgccattgcactaacaggttgtgcaaataacaacgacacgaaacaagtgagtgagcgtaatgattcccttgaagacttcaatcgaacaatgtggaaatttaactataatgttatagatcgctatgtgctagaacccgctgcaaaaggttggaataactatgtgcctaagccgatttcttctggtcttgctggcatcgcaaataatcttgatgagccagtcagtttcataaaccgattaattgaaggtgaaccgaaaaaagcatttgttcactttaatcgcttttggattaacactgtatttggactaggtggttttattgattttgcgagcgcaagcaaagaattacgcatagataatcaacgtggatttggggaaactttaggcagttacggcgtagatgctggcacttatattgtgctaccgatttataatgcaacaacaccacgccaattaacgggtgcagtggttgatgcggcttatatgtatccattctggcaatgggttggtggtccgtgggcattagtgaaatatggtgtgcaagcagtggatgcccgtgcgaaaaatctcaataatgcagaattgttacgtcaagctcaagatccatatatcacgttccgagaagcttattaccaaaatttacaatttaaagtaaacgatgggaaattagtcgaaagcaaagaatcacttcccgatgacatactaaaagaaattgattaataaacagaaaagtgcggtaaaaattacccaattttttatcaactaaggagaaaatgatgactcaaattattcatactgaaaaagcaccagcagccattggcccttatgttcaagcggttgatcttggcaatttagttttaacctcagggcaaattccagtgaatcctgcaacaggcgaagtgccagctgacatcgttgcacaagcacgccaatctttagaaaacgtgaaagcaattatcgagaaagcaggtttaaccgcagccgatattgtaaaaacaacggttttcgtgaaagatcttaatgattttgctgcggttaatgcagaatacgaacgtttctttaaagaaaataatcatcctaacttccctgctcgttcttgcgtagaagttgcgcgtttaccaaaagatgtgggattagaaattgaagcgattgcagtgagaaaataattttctgtttggtaatttctgcttaaaagtgcggtcataaactcgcatgtttttgaccgcactttttgtttatctgctgataacaaaaattttacattacaccttgaattttttatgaattttccccactaagggaatacttaaccctaactttgagagaacacattatgatgcgtattcttcttttcttggcaaccaatatggctgtaatgctggtattaggtattattttaagtgtgactggaattgcaggaaatagcaccggcggtattttaattatggctttgctatttggttttgctggctcattaatttccttattcctgtctaaaacgatggcattacgttctgtagatggagaggtgattactcaacctcgtaatcaaactgaacgttggttaattgataccgttagtcgccaagcgcagaaagcgggtattcctatgccagacgtggcgatttatcattcacccgatgtgaatgcttttgcgacaggtgcgacaaaaagcaattctttggtggctgtgagtacgggattattaaacaacatgacggaggctgaagctgaagctgttttagcgcacgaaatttctcatatttccaatggggatatggtgacgatggcgttattgcaaggcgtattaaatactttcgtgattttcttatctcgcgttatcgcaacggcggtagcaagttcgcgtaacaataatggagaagaaacgcgcagttcaggtatttatttcttggtttcgatggtattggaaatgctctttggtgtgcttgcaagtattatcgcaatgtggttctcgcgctaccgcgaatttcgtgcagatgcaggttccgcaagtttagtaggcaaagaaaagatgattatggcattgcaacgtttgcaacaacttcacgaaccccaaaatcttgaaggttctttaaatgcctttatgattaatggtaaacgcagtgaactctttatgagccatccaccactcgaaaagcgtattgaagccttacgtaatctttaaaaattataaaaaatcgaccgcactttaatgaggtcgatgttttattttcctcttttcacccaatatttgaacgggggcttttccacttcacattgcagtaatgtgtgatccataaattgacagaaacttggaatatctcttgttgttgcaggatcgtcagcaataatcaaaagtatttctccatcgttaagatgacgaatatttttacgaacaagcatgacaggttctgggcaacgtaatcctaaagtatctagggtttgtgtgacggaaatttcagacatattcttttttcttttgaaaagcagaaccatatcataccgcacttacggcaaaatttcgacaaatcccagtcatcagtgatagactagtgtcattgaaattaccttgaaaaaagaaatggcggaatacctcgttcctaaaagtgcggttgtttttgaagaagaaattaagaaaagccgttttattacttatttacagcacaccgaaggtttagaagacgcaagagctttttgggcaaagattaaacaagaacatccaaatgctcggcatcattgttgggctgccgtagcaggcaagccaacagattctctacaacttggtttttctgatgatggcgaacctgctggaacggcaggaaagccaatgttgagtgcattgcaaggcagtcaattaggtgaaatcagtgcggtggtggttcgctattatggcggtattttgcttggaacgggcggattagttcgtgcttacggcaatggtgttcaacaagcgttaaagctgattgaaagcgaaattaaagttgaacgaacccttttcaaacttgattgtgactatggtcagttaaggttggttcaacaactttgtgaaaaatatcaggttgagattttatctcaaggttttcaggcaaatattcatttgattttaggtattagtgaaaaaacaatagaggcgttttcttcagaattaacggaaaagtcttcaggtagattagttattcaacttttagagataggcgaatagttgtgcgtattttatcgattatccgaattattggtattcttgtgatgtgtttttcaggtacgatgctagttcctgcatttgttgctctgatttatggtgatgggggcggcaaggcatttatgcaggcttttatgttgagcttgattgcaggtacattactttggtggccatgccatcaccataaacaagaattacgatcccgtgatggttttttgattgttgtggctttttggttagttttaggaagcttggcaacattgcctcttttattgttcgattcaccacatttaactattgcttcagccgtatttgaagcattttctggcttaactactactggtgcaacggtaatgacggggctggataatttacctaaatctattttgttttatcgtcagtttttacaatggttaggtggtatggggattatcgtattggctgtggcgataattccgctgttgggaattggtgggacacaattatatcgagcagaatcttcaggccctcttaaagatcaaaaatctttgcctaaaatttcagaagtggcgaaagctctatggattatttatgcttcattaactgttctttgtgccattgcatattggctatcaggaatgaatctttttgatgccattgggcatagtttttcaacaatttcaaatggcggattttcaacgcacgatgcaagtattggctattttaatcaagcttccatttattgggttacaacaatttttatgctgattggtggtgttaattttagtttacatatttccgcttttcttgcactaggtaaaagaaatatttggcgaaattattggaaagatcccgaatttcgtttttttctaacgatgcaaattatttttattggtattgtatctctatctttatatggttatggtttagtttcagatataaacgaggcagtaacaaaaggtgcattacaattaacatcaatgtcaatgactgctggttatacgatttttgatattgataatcttccgccttttattgggcttttactggtaatttctgcagtaattggtggttgtggtggttcaacaactgggggattaaaagcgatacggacacttatattgtggaaacaaatcgatcgagaactgcatagtttaatccatccaaatttagtacaaccaattcgaataggtaaaaatcgtctagcaccaagaatgatagaaagtatttgggcatttttcattattttatactggtttattgggggtgtgtttttgctgttattctttgtggaatgaatacttttgatgcgatgggagccgtattcgccacattaacgaatgcaggaccgggacttggttttattcacgaaagttttattggtgttccagaaagtgctaaattagtctttagttttgctatgatctgtggacgtttagaaatgttttcattaatcgtgctgtttattccaagctattggaaaaaataataattgaaaaattattgcatttttaaccgcactttttaataaaatgtttatatttccatcaaaagatcatttttttaaatatttttacaaaaagtacttgcaagggatttgaaaatccctataatgcaccgcacacaacgacgccactgttgtgaagttttttaagtttccaagtgcgtcgttattttttgctctttaacaatatatcagacaatctgtgtgggcacttgttgattgacttgttttaaaactatttttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagtacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttactgaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaaacgaaaggtgtagtgtaaataaataataactaagacataaatgattagttattaaattatgatgaaatggggatatagctcagctgggagagcgcctgccttgcacgcaggaggtcagcggttcgatcccgcttatctccaccacttatcattgttaagtaaattagaaaaagacaaattaataaagtattaaggtagtgattaagctattttaaatattaggttattttattcttagttttaagtttaattttaaatttaattttgttttagtttatttaacgatgataactgaaaagttttatcaactgttctttaaaaaattggaaacaagctgaaaacaagagattttcgagagaaagtctgagtaggcaaaacagtaaagtgaaagagagaactgaaaaggaaactctaaaaacaaaacctgttttgtaaaaaaatcttgattgaacaaaagcaatcaagtgtttagttgaatgaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcaatatagtgaggagaatgtgttgggaagcacaatcaaagagggtgataatcccgtatctaaaaaccatattgtggtactaagctaacgagaagtagggcgggacacgtgatatcctgtttgaagaaggggggcccatcctccaaggctaaatactcctgattgaccgatagtgaaccagtactgtgaaggaaaggcgaaaagaaccccggtgaggggagtgaaatagaacctgaaaccttgtacgtacaagcagtgggagcgagggcaaccttgtgactgcgtaccttttgtataatgggtcagcgacttatattttgtagcgaggttaaccgaataggggagccgaagggaaaccgagtcttaactgggcgaatagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctagggggccatcccggcttaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcagaatttattctgttgggtaggggagcgttgtgtaagcggaagaaggttcatcgagaggtgggctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtaagggctagcccctgaaggttgaaccggtcgaagataccagctggctgcaactgtttattaaaaacacagcactctgcaaacacgaaagtggacgtatagggtgtgatgcctgcccggtgctggaaggttaattgatggtgtcatcgaaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgtaggatgattgattggggctgctcctagtacgagaggaccggagtggacgcatcactggtgttccggttgtgtcgccagacgcattgccgggtagctaaatgcggaagagataagtgctgaaagcatctaagcacgaaacttgccaagagatgagtcatccctgactttaagtcagtaagggttgttgtagactacgacgtagataggttgggtgtgtaagtgatgtgagtcattgagctaaccaatactaattgcccgagaggcttaactatacaacgctcaagtgtttttgggagctaagtgaagtaagagatgaaaagcgaagcaaataaaagcagagcgaaagagaagtaaaagactaaacaaagaaaagtaaatatagaagacttaatagaaagaaaatcggattcagcttgtgaccaataagaacgagtgaaaggtagaggaaagactgagtaacgagagataaaagagacgagagataaaagagaaaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttaccaaatacttatctaagttaaataaaaacagaagaaccccgtgtcaaaagatatggggtttttgttttttagaagtttatactttaacaaaataagtttagataaagtttatgtttgttagtgagaaaaatacgcactagtgatacaatccacaaaattttaagaaaggtaccctatggctcgtaagaaaaaaacacgtcgaattacagatattatgccaattcgcaaagcagataaaaaaatagatataacaaaagcacgctctggtaaaaagcttacttgttatgaattggatgctaaagctcgtgaagataagaaaaaacgtaagcataaaggtttagcttcaggatctcgtcatagtgcggttgaagaaaaagcgaataaacttcaaaatgaaattaaagatccaaaaattggtagtaagaaaaagataccgttggttgttgaatttgttaataagcctgaaaaaggtcaagtaattcctgtaataaaacaggtgaaaaaacaagatccaatgaaagagcttgaaaatctggaaaataatgaaattcttaatgaattattggatgctttagatgcgggtaaaactattagtaaatcagatcaacaatttgtagatgaatgcttagatcgaatttctgaattaatggaagaacttggcattgaagatgaagatgaaagcgaagatgatttataccgcactttcgagcgtatggatattaatcaatttaggtaatctatgatttggatattttttgtcatcgcacttttcttggtaactggattgactctatatgcaatccgtttattaaagcagttaaaagttcaaaaggaattgattgctaaagctaagaataatcgggttatacgattaaaagagagcattgatattattgctcgtgcaatgcagtctggagaatgtaatctttctgaaggcgtaatgcgtcttacaatgctattaagaccttttggtaagaatttatcatcttatcctgcgatggctaatttatatgaagtggtgcgtgatatgcctacacatgatgaccgtaaactacttgagaaaagagaaagaatgcgtctggatttagctcgagaaagtgcagaagcacagtttgaaaaaaatattaaacaagaattgtatattttattagaagatattaaatctattgagctaatttaaatattataattttaaagaaaaatgcgctaagtctctcctagcgcattttttatgattatttttaacgattttgttcaaaaaataataccgttgctgcaacacgagaatgaacatttaatttacgtaataaattacggatatgtacttttacggtttcttctgaaataaacagttgtgctgcaatttgtttgtttgataagccagttgcaatttgacgaagtacgcccatttcgcgatccgttaagctgtctaacggattatcttcgtgagtacgttctaataataaatttttaatagaatcactcagaatgacttcgccttgtgctatgcgcttgatttgctctagcaatgtatcaggttcagtatcttttaacaaataaccatctgcaccagcatcaatcagagtataaatatcattttttgcatcagacactgttaaaattaaaattcgcgcatcaacgccttctgcacgtaatcctttgagcgtatctaacccagaaagtcctttcatgttgagatctaaaatgatcacatcaggtgatgtttgtaatgccacagaaatcccttctgtgccgctgcttacgtcagccactacttcaaagttatcgtctaattctacaagttgtttaatgccacgacgcattaacggatggtcgtcaatcaataaaacttttagcttatcttgcataatttctcctttagtggttagaagtccactttaaaaagcataacattttataaagaattcaattctatgccaatctagaatagaaaaaaatttgatttatctcaaaaacttactatttgaggtaggtttattgatggataaaaatagaaaaagtgcggtagaaaaatagataattttttaccgctcttttttaagataagaaatattaaatggtcgattctaatgcccaaagttcctgtaaggtttctcgacgacgaattagataggattgatcgccatctactaaaacttctgcagtgcgggctcttgaattatagtttgatgacatacttgctccataggcaccagcagaacattgagcaatataatccccttcagcaattgaaagttcccgttgtttgcctaagaaatcagacgtttcgcaaacaggccctacaacatcataaatggctttttctctttctaaagtgcggtcaatttcgacgatgttcatgtaagcctcatacaatgctggtcggatcatatcgttcattcctgtatcggtaatggcgaaattacggctttcattactttttaagtattgtacttttgctactagaattcctgcatttgcagaaattgctctgccgggttcaagaataatttcaagttcgggataattttttagtttttctaataacgcatttgcgtaatcgcttggatgcggtggtgtttcatccgtataagtcacgcctaaaccaccgcccagatcgagatgttttaatgtaattccatcttcttttaattgttccattaggacaattaatcgatctgttgcatctaagaatggttgtaattcggtgagctgtgagcctatgtggcaatccatccctgttatttttatgtttggtagcgttgaggctaatttatatacctctcgagcttcatttacgcttacaccaaatttattttcttttaatcctgttgaaatataagggtgtgtatgagcatcaacatctggatttacacgtaaagaaataggtgcgattttacccatttctcccgcgatttggttaatgtgcttgagttcagaaactgattccacattaaagcaacggattctaacttctaatgcacgcataatttcttctcgagatttcgcaacgccagaaaagaccacttttgacgcatcgccacctgctgccagtacacgctcaagttcgccttgcgagacaatatcgaaacctgaaccaagttttgccataatatttaacacgccaatatttgagcaagatttcacggcaaaacaaattaagtgaggacgattaccgaaagcagagtcaaaagcgtgccaatgacgttcaagtgtcgcgcgagaatatacatagagaggcgtgccaaattgttcagcaagttgttgaactggcatatcttcggcataaagtttgttatgtttatattggaagaaattcatgttgtgtgcctgttttagttattttgggaatgatattagataatagattattgagtttgttgagcttgatctttttcaggaaaatataaagaaccttttacgccacatcctgtagcgaatatacaagctgaactaagtactaaaattaatagtaattttttcattttttctttctcacttatcggtaaatccgcctttcacaagcttgagaaaggctttataatttgccgcattttatcagatttaaacaggaaaattttatgaatattgcagaatttcaccaaaatattgaacaagtttggcaaaaaattgaagaagaattggaaaaccaaggcgcagatgtagattgtgaaacgcaaggttcmrgtatttacaatcacctttgataatcgcacacaaatagtggattaacaaacaggaaccgctgctggagctttgggattgcaagttaaattaggcggtttccattttgcttttaaaaatggcgactgggtttctaatgacggacaacgtttttgggattgtttcgttgaagcctgtgctgcacatggcgagaacgtgcagttctaaaatgctggattctcctttactatcaaaaataatagaaaaaccgaccgcactttctgttttgaaatcggttttcggttatcaatctttccgtaaagggcaggaagaagttattaatgctgctttaaatggacaagatgcgttggtggtaatggcaacggggaatggcaaatcgctttgttaccaaattcccgcactttgttttgatggtttaactttagtgatttctccgctgatttccttgatgaaagatcaagtggatcagctgcaagctaatggaattgaggcggattttcttaattctagtcagactttagaacagcagcaacaagtacaaaataagcttatttctgggcaacttaaactactttatgtgtcgccagaaaaagtgatgacgaacagtttctttcaacttatttcttatagcaaagtctgctttattgcgattgatgaagcacattgtatttctcaatgggggcatgactttcgccctgaatatacccagcttggcggtttaaaagccagtttccctgatgcgccgattatggcacttacggcaacggcagattatgcgactcaacaagatattctgcggcatcttaatctgaaaaatctgcacaaatacattggtagttttgatcgaccaaacattcgttataccttggaagaaaaatacaaacctatggagcaactgacacgttttgttttggctcaaaagggtaagagtgggattatttattgcaacagccgaaacaaggttgaacgaattgcggaaagtttacgcaataaaggtgtctctgctgctgcttaccacgcaggaatggaaacggcaattcgtgaacgtgtgcaacaggattttcagccgtgataatgttscaagtagtagtcgcaaccattgcttttggaatggggattaataaatccaatgtgcgctttgttgcccattttgatttaccacgtagcattgaatcttactatcaagaaacaggtcgagcaggacgcgatgatttacccgcagaggcggttttgttttatgaaccagctgattatgcttggttacaaaaaattctcttagaaaaaccagaaacgccacagcgtcagattgagcaacataaattagaagctattggtgaatttgcagaaagccagacttgtcgccgtttagttcttctcaattattttggcgagcatcgacaaacaccatgcaataactgtgatatttgccttgatcctcctaaaaaatatgatggtttagtcgatgcgcaaaaagtaatgtctactatttatcgagtgggacaatgttttggtgcacattatgtgattgcggtgttgcgtggcatgcacaatcagaaaattattgaacgccaacaccataaactttcagtgtatggcattggaaaagataaaagtaaagagcattggcagtccgtcattcgtcagcttattcatttgggttttgtgcaacaggttattagtgaattaaatccaacgttgcaacttaaagtgcgaaagtgattttgaaaggcgaagaaccgttagaattggcaatgcctcgtatttctgcaatcagtaaaattgctcataatccacaacgtcaaggtgttgcaaattacgataaggatttatttgcacgcttgcgtttcttacgcaaacaaattgccgataaagaaaatattccgccgtacattgtctttaatgatgcgactttgcaagaaatggcacaatatatgccaacaagcaatattgaaatgctgcaaattaatggcgtgggctctatcaaattagagcggtttgggcagccgtttatggcattgattcaagaacataaggcaattttggcgaatgcgcaaaataatgactaagtgttaaaagtgcggttaaaaatgaccgcactttttgttatacttgcgccaattttttcagttcttagaatttaaggttaaacaatgcgtacaagtcaatatttattttccaccctaaaagaaacgccaaatgatgctcaggttgtgagccaccaattaatgttgcgtgcaggtatgattcgcccaatggcatcaggtttatataactggctaccgacgggtattcgcgtattgaaaaaagtggaaaaagttgttcgcgaagagatgaacaaaggtggtgccattgaggtattaatgccagttgtgcaacctgcggaattatgggaagagtctggtcgttgggatcaatatggccctgaattgcttcgttttgaagaccgcggaaaccgtaactttgtacttggaccaactcacgaggaagtgattacagatttagtccgccgagaagtttcttcatacaaacaacttccacttaatttatatcaaattcaaacgaaattccgtgatgaagtgcgccctcgttttggtgtaatgcgttcgcgtgaatttattatgaaagatgcgtattctttccacactacccaagaaagtttgcaagcaacctatgatgtgatgtatcaagtatacagtaacatttttaaccgtttaggcttagatttccgtgcggtgcaagcggatacaggttcaatcgggggttcagcttctcacgaattccaagtgttagcttcaagcggggaagatgatgttgtgttctcaacggaatcggattttgccgcgaatattgagcttgcagaagcaattgctataggcgaacgcaagctccaacggctgaaatgtgtttagttgatacaccaaatgcgaaaactattgcggagttggtggagcaattcaatttaccaatcgagaaaaccgtaaaaactttgattgtgaaaggtgcagacgaaaatcaaccgcttgttgcgttgattattcgcggcgaccatgaattaaacgaaatcaaagcacaaaaacacccgttagtggcagatcctcttgagtttgcggacgaaactgaaatcaaagcgaaaattggttcgggcgtgggatcgttaggcgcggtaaatcttaatattcctgcaattattgaccgcactgtggcgttaatgtctgattttagttgtggtgcgaatatcgacggcaaacactacttcaacgtgaactgggagcgtgatgtagcaataccaaaagtatttgatttacgtaacgtagtagaaggcgatcctagtccagatggcaaaggcacgcttcaaatcaaacgtggtattgaagtggggcatattttccaactgggtaaaaaatactctgaagcgatgaaagcgaccgttcaaggcgaagatggtaaaccacttgtgatgacgatgggttgctacggtattggtgtaactcgtgtggtggcttcagccattgagcaacaccatgatgaacgcggtatcatctggccatcagacgaaatcgccccattcactgtggcgattgtgccaatgaacatgcacaaatctgaagccgtgcaaaaatacgctgaagaactttaccgcactttacaatcgcaaggcgtagatgtgatttttgatgatcgtaaagaacgcccaggtgtgatgtttgcagacatggaacttatcggtgtaccgcatatggtggtaatcggtgagaaaaacctagacaacggtgaaattgaatataagaatcgtcgtaccggtgaaaaagaaatgattagtaaagataaattgctcagtgttttaaacgaaaagttaggtaatctctaatcagtattttattttgtatattgtgacaaaagagcggttaaaaatagccgctctttttgttgatctaacgtttatattgaacaatgtttaatccaaactaaatgctcgaatataaggtagttttcctttttctaacatctcttgaataccgctttgatggtcattgctgcctaacccccttaattctaaggttatgccaatgctattatcataaacaatttcattacgtgtttggttttggtggtttgtgacattgcgttttacaccaacacttgcagcccaacagcaactgttatattgaacgcctagatattgttctactggtttttgtaaggcgagatcttgataatagcgtcctactacagcccaattattggcaatttcccagcctacaactaatcccacttgttggatatcttgttgataggcgttagcgatttacctaagttttggtcaatatattcttggttcgcatatcgataatttaactgaattaaattatttttttcaggattatattctagtgatgtattcgctaatgatgtcgaattggtatgagtatcaaattgatagctaccacgccaataccatttattacttattttccaattagattctaatgcccaagcagatgatgaagttggtgttttattcgcagggttttcatcaatacgagaattacttaagtaataaatttgacctgcagataaattaaatcgttcttcgccagcaatatcataaaaacgcgttgtgccacccaaggtaacttgatttgccgatgaaattcgatctaaaccactataacggcgatcacggaatagcgaatagtaatcttgctgtactaatgctgaatcgtaaccaaatcccaaataatcattattaagtgttgaaccaatattgctttgatttcggtaaggacgatataaatactgcacgtgcggttcgaaggtttgtgtatactcttttaagaacgttatatcgcgtgccaatacactttgtaaatcaactttaaattgtggaataactcgatttaccgttttttgcacgtcctctgcattttttcctgaaccttttttctgctcgtaacgagtcgcataaagtttcgtttcaatattcaaactgccgtatttatttgacattaaagaatttaggctaggttctgcatggaaacgccatgcagttggcatcaatttactgtcattatcaaaacgaactgcttgtgaatgtaatttgaaatttaaccatccattcgctaaatcatatttgtgatagttgaaatctaattgtggtactgcacggtaagggccgatgtttacaatatcatcaaaaatttggaactgatgtgcagaaagagaaaaattataatttggttgataataagctatgcgagcatattggttcgcataaccatcggtactgcgtccataaatagaatcaaagtcgttgaaataacgtttatcgcttactcgggtgtaattaatatttagacgccaattttgtaaaaagctagaattgtgattccaatagaacaaatgacgttttcgattatcactagcatattcagagtaacgaaccttacctaaatattctcctgccactttaccttcaccaatagaggttaaatagcgaaattccccatttgcttgccaaccacggcgagacatatatttcggggtgaaagtaagatcataattaggcgcgatattccaataaattggttgtgcataccaaagaccatcttggctggatgttcccgcgcttggaatcaataaaccagaacgacgacgatctccaatgggtaattgtaagtaaggggtataaaagacgggaacaccgtgtattttaaagcgagcatgccacatttcagcatattcttctttcacgtattgacgaatttctgacgcatctactgcccaagcattgtcgccgtgcaaacatgacgtaaaggttgcattcttcattacacgataattattatgcagtgttatattatcagctttaccacgtccttgacgaccgacaaattcatattctgaatttgttaaattaccatcgtgactatctaaattaaactctgcatctttacccaacatattgatctgattatctttataatcaaatccattgcggacataagccatgcgtaaaggtgttgattggtttccagattgtttgacctgcacggattgtgctaacaaatggcgattgccttgtttcaaatctacattaccttgataggtcgcatcatttggctgattaatttctgcgttatccgcttcaatatagacaggcagagcattcacatcacccgtcacgacttcaccgctaaattttggcacgcccattaaacattgttcatgcaaatctgccaaactttgttggctataaagtgcggtcaaaatagcaagtgaaattaaagtgtgttttttattcatcgtcttgttttaatttgtcagaaaattggtcagattatactggaaaaagtgcaaggctagtaatatttttcaagaagtgattaatagaatatccactgggttatgattaaattttttgtctattgaaccatcaatacgccaagacagcccatatcttctaacattaaattcgataccccaaataagaatgggtagttgccagaagatgcttgatcaaatttcactaaaatttgagttttgttttttacccaaacggtatctttccaagctaattcttcagcttgtaattgatgttctccttggctttccaccacaaatttggcaccttgaatagtaaatccaacaggtaaacttgcatttaaaatccagcgttcaatggtgcctttacgagccataacatcaaccttgcgtgggtcaaaacgtctttggttaattaagccgtttgtaacatcaatattattctcgagtttgtgcaacggcttgttgtaatattgctggtgcatccgtttcgaaagttagattcggttgtttgttaaatgcggatagttgtccttgagcacgtaattcaaggacggtgttattagcgagttcatcgcctgagaacaacatattttttatttttcgtacaagctacgtttacttccgctaatgagagatacgttgtcaatttcatcatattaaccagtatttctgcgcgttctcctggcgagagaaccaaagatttgactgatttagcttttggtaagaaacctaaatcttgtgcaataagcagcatttcttgatcattatccaagcgtaaatcataagcacgcgctaatgaggcattgagcaaacgtaaacgaatccaaccccgtgcaacatctaaatatggtgcttcaataccatttactaataagcgattgcctacaaagtgcggttgattttgtttgaataattggagaccatcattgttaaattccatatcttgtaaaatcaatggaatatcatctacgccgtatttattgggaagattagcttttaggctttgctcatcttcaattaaccacattccagctaagccacgataggtttgataggctgagttggctaatgtcgcggaacgataccagcagcttgctgcaggttgttcaataggcacgatgggtgcccaagattcgccttttttgagaactcgagctgccccgccaaacagttcgcctgatgcttgtaaaccttgaatagataaagcaactgattgtggcaaattgttatgataattaagtttggcaaagctgcctgatttgattttaatggttgggccaagataattaccgttgaatccccatactgtcacattgtgtgagccatctaacggataattcgtttcctgcatggttaatacaatcgggcgaccgcgacgaacttcaattagtggcggcacaactagtttttcacggcttgccgctaacaatggtgctggcactgtggaaagtgcggtagaaatcgcagctgtttttaataattgacggcgggaaaggcgtggcattttagtttccttttgctatctcttcatcaagttcggcaatgcgtttttccattagatcatgacaataagccgcaagatcgcgaacattgtctttggtatagcctgaaacatcgattggatccattatttcgcaaatcactttgccattatcccaacgatttaaattaattttgttatgcgtgcttgaacacaccactggaataattggtacacctgctgaaatcgctgcatggaatgcacccgttttaaagggtaataaaccgcgaccgcgattgcgagtgccttctgggaacatccaaattgataaattatcttcattaattcgtcgtgcaagctgtgacatcgtattatgtgcttttgtgcggttttctctatccaagaaaatattacccgttacccaatataaaattccgaagaagggtatccaaattaagctttttttacccacgcttactgtacgaggttgcaccatataagagattgttaccatatcataattattttgatgattaccgatataaatggcgcggctaatttgcttctgatcttgaggaatacgatgttctacctttaagccaaaaagtggatataagcgtccaaaccaacgtgcaacaatgcctacgttgcttggatttttaaagcggataaaagaataaatcgtacccagtacacaaattagaatacagcagattaatacgaggaaaattcgaagtagttttaacataaggatgtcctatataaaatttccttgaagtataacaaattcgatctcaatatgtgctaatctaaacaaaaatcgtggaatttttatgaaacatagctattttatttctgatttgcatttaagcgaaactcagccagaattgaccgcactttttgtcgattttatgcagaatcttgcccctcaggctgaacggctttacattttgggtgatctttttgatttttggattggtgatgatgagcaatctgcattgattcaacaagtgaaagatttaattaaatttgtaagtgatcaaggtgtgcaatgttattttcagcacggcaaccgtgatttcttgattggtgaacgtttttcaaaagaaacgggagctcagcttttacctgattatcaattgattacactttatgataaaaaaatcttactttgtcatggcgatacgctttgtattgatgatgaggcttaccaacaatttcgccgtagagtgcatcaaaaatggctgcaacgtttgtttttgtgcttgccattaaaagtgcgggtgataattgcggagaaaattcgagcaaagagtaatcaagataaacaagcgaaatctcaggaaattatggatgtaaaccaagcattcacggcagaaaaagtacaagaatttggtgtaaatttattaattcacggacacacacaccgtgaggcgattcatcaacaagaagaatttacccgaattgtattaggggattggcgaaaaaattacgcatcaattttaaaaatggatgaaagcggagaatttggttttattaaagattagaattgcggtaaagcaaaaactcgttattttacttaatgatactagaataatacttatccataaaatcatacctaaaagctggtggataagcccaacttttagatacagataaaagtgcggttaattttaggattagttttctttcggtaagcgaagcaacgcgtaaattaatcctccccacaataaagtaagggctatgatcatcataataattgcgccagtagtcattttattctcctttagtttcatcaatcgttaatttggtttcgcttttccattttaagcgagaaaggaaacatgccacgacaagtaagctaatcgacattccccaaccaaaggtatttacaaaccagtttggataaccttcataaccctcagagaagacttttgccccttcgctgaaaagcataaatgctaaaacaccactcgttaatacaatgcataaacgccagaagaaacccactttgaaagatgacgtttcgtttaagtgattacctaataaaccgagtttttcatttgctacaatcgcaattaaagacgcaaatgctacggcaacaataccgaaatagttcacaaatttatcgaacacatctaacatcggtaagccagttgttgtgccgaataagatgacagaaactagcatcattggtacacccacgatgaatgtcacttttccacggctaatgcgaattttatcctgaattgcggaaataattacttcgataactgagatgaatgaagtcaatgcggcaaaggttaatgaaccaaagaataacatgccgagcacttcgccaaatggtgctttgttgatgatggttgggaacgcaaaaaatgctaaaccaattccgccttttgctacttcgctgacttcttgaccttgcgctgtagcaataaaacctaatgctgcaaatacgccgatacctgctaacacttcaaagctactgttagcaaaacctacaaccaagccactaccagtcaaatcggattcttttttaagataagaggcgtaagtcaccataatcccaaagccgattgaaagagagaagaagatttgcccataggccgcaatccacacacttggattagaaagttttgaccaatctggcgtaaataatgcatctaaaccttttgccgcacctggtaagaataaggaataaatcacaagcaccataaacatcacgacgagcactggcattaatacggaagagaccttagcaattcctttttgaacacccatagaaagcacgcctaaggcaacaatccacatcgcaattaatggtgcggttaccataccaacaaattcaaagctgataccgtttttaatatcgcccatttttaaaaatttaccgatgaagaaatcaatgggtttatcgccccacgcgccagtgaaagaaaaatatgtgtagcttgctgcccagcctaatactacagcgtaatataatccgatgatgacattcaccatcatttgccaccagccaaacacttcaaagtgcgggctaaaacgacgataagaaagtggcgcaccaccacgatgacggtgcccaatggcataatctaggaataaaagaggaatccctgccgttaataacgcaataaggtaagggatgataaatgcgccaccaccgttttcataagtggtgtaaggaaaacgccaaatattaccaagaccaacggcagaaccaattgctgccagaataaatgcgcgacgaccagaaaaagtctcacgcttttgtgcttttggggctgagtgagccataaattatcctatgtaaaaaaatgaaaagagtttcaatataatgaaatctaatcatcagtcaataaataagccaaaagagcggtaaaaattcactaaattttttaggggaagaacaggaatattcaaaataagccaattttcaccgcactttttttcgtttttttctctccaagccctaccaatgactcgaaatttcgctacaatgctgaacttatccccaaaataaaaacaacaggaaacaaacaccatgacaggcgcacaactcattatggcgtgcttgaaagcacaccatgtcacgactcttttcggctatcctggtggcgcaattatgccaacctacgatgccctttatgacgcaggcttagatcacttactttgtcgtaatgaacaagggactgcaatggctgcgattggctatgctcgctccacgggaaaagtgggcgtctgtattgcaacatcaggccctggtgccactaatttagttattggattaggcgatgctatgatggactccattccagttgtcaccattactggtcaagttgcctctccattaatcggcacagatgcgttccaagaagcggatgttctaggactttcccttgcttgcactaaacacagctttattgtgcaaagtgcggatgttgccctacaaggggatttaatccaagcgcttaatgcgctcaaacaagatcttgatattgaaccttggcgtgaacaaatcagaaatttcaaagcaaaattagatttcacttatgttgaaaatcaaggcaatcgcccgattgatccttgggcattactcaacagcctatctaatcgtaaaccaaataatgcgataatttgtactgatgtgggtcagcatcaaatgtggttagtgcaacacattttacgcgtagcacgtcactgcggatttaccgttacaacaatggaaatgacactcattgaaacccaagtgcggttaaaaatcactgtaaaatctgaccgcactttagatctattagtgaatcagttggttaagctgccggatgttttaatggttaattaagaatattttatcaattaacgaagaaattaatcatacaaacgaaccctaaattttactcggagagattatttatgcccaaactacgttcagcgaccagcacacaaggtcgtaatatggcaggcgcacgtgccttatggcgtgcaacaggaatgaaagaaaatgactttggtaaaccgattattgcggtggtgaactctttcacgcaattcgtaccagggcatgtgcatttaaaagatatgggacagcttgttgccgcagaaatagaaaaagcgggcggcgtagcaaaagaatttaacaccattgcggtggatgatggtatcgcaatgggtcacggtggaatgctttattctttaccaagccgtgatttaatcgctgatagcgtggaatatatggtcaatgcacactgtgctgatgcgatggtgtgtatttctaactgtgacaaaatcaccccgggaatgttaatggcggcaatgcgcttaaacattccgacaatttttgtttcaggcggcccaatggaagcgggcaaaacaaaactttctgatcaattaatccgcttagatttggttgatgcgatgattgaggcagccgatccgaatgtatcagatgaacgtattgatgccatcgaacgcagtgcgtgtccaacttgtggttcatgttctggtatgtttaccgctaactcaatgaactgcttaactgaagccttaggtttatctttacctggtaatggttctatgttagccactcacgcagaccgtaaagaattattcttaaaagcaggtcgtcaaattgtcgagctttgcaaacgctattatgaacaagatgatgcaagcgtattgcctcgttcaatcggtacttttgatgcctttgaaaatgcaatgagcctcgatatcgcaatgggtggttcaagtaacactgttttacacttattagcggcagcacaagaagcaggcgtggattttaaaatggaagatattgaccgtttatcgcgcaaagtgccttgtttaagcaaaattgcaccaaacaccaataaatatcatatggaagacgtacaccgtgcaggcggtattatgggattgttgggtgaattagatcgtgctggattaattcataaaaatacacacaccgtgcttggaatgagcatgggagagcaactagaccaatacgatattattcgcaatcaagatgaagaattacataaattcttccgtgcaggccctgcaggtatccgcacaactcaagcattctcacaagattgccgctgggataccgttgataatgatcgtgtaaacggttgtattcgcaataaagaaaatgcgatttcacaagaaggtggcttagccgtattattcggtaatctcgctgaagacggatgtatcgttaaaaccgctggtgtagatgaatctatttggaaattcactggcacggcaatcgtatttgaaagccaagaagatgcggttgcaggcattttaggtggcaaagtcaaagaaggtcatgttgttgttatccgttacgaagggcctaaaggcggaccaggtatgcaagaaatgttatacccaaccagttacttaaaatcgatgggcttgggcaaaaaatgcgctttattaacggatggtcgcttctctggcggtacatcaggcttgtctattggacatgtttcaccagaagctgcttctggcggtgcaatcggcttagtacgcaatggcgatattatcaacattgatattccaaaccgtgcaattaacttagaaatcagtaatgaagaactcgcaacacgcagagccgaacaagatcaaaaaggttggcagccagctaaccgtgaacgtgaagtatctttcgctttaaaagtattcggtcactttgcgacctcagcggacaaaggtgcggtacgcgataaaacattattaaaataatttaacggttcccctctttcataagagggggataaaacaaaggaaaaactaaccgcactttatcatcaaaacaaacactatgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggcgcttacgcaatgatttctagcctttcagcagaacaaaaagcagctggcgtaatagcagcctctgcgggtaaccatgcgcaaggcgtggcattatcggcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaacatgacatttattccaccattcgatcatccattagtgatcgcaggacaaggcacgttagcgatggaaatgctacaacaagtggcggatttggattatgtgtttgtacaagttggtggtggtggcttagctgcgggtgtggcaattttgcttaagcaatttatgccggaaattaaaatcatcggtgtagaatcaaaggattctgcgtgcttaaaagcggctctcgataaaggcgaaccaacagatttaacccatattggattatttgccgatggcgttgctgtaaaacgcattggcgacgaaacattccgtctatgtcagcaatatcttgatgatatggtattggtcgatagtgacgaagtatgcgcagcaatgaaagatttgtttgagaacgttcgtgctgttgcagaaccatcaggtgcattaggtttggctggtttgaaaaaatatgtaaaacaaaaccatattgaaggcaaaaatatggcggcaattttgtctggcgcgaacttgaatttccacacattacgttatgtatctgaacgttgtgaaattggtgaaaatcgagaggctttattagccgtgaccatgcctgaacaaccaggtagtttcttaaaatttgcttatgtattaggtaaccgagctgtaaccgaattcagttatcgttatgcagatgataaacgcgcttgcgtgtttgttggggtaagaacgacaaatgagcaagaaaaagcagatattattgcagacctcacgaaaaatggttttgatgttgaggatatgtctgatgatgatattgcgaaaacgcatgttcgctatttaatgggtggtcgtgcagccaatgataacgaacgcttatataccttcgaattcccagagcaaaaaggtgccttattaaaattcttggaaaccttgcaaaatcgttggaatatttcattattccactatcgtgcccatggtgcggactatggaaatatccttgcaggtttccaaattgaacaacgcgaacaagcagaatttgnacaggcacttgcccaactcaattatgtttttgaagatgtaacaaaaagcaaatcttatcgttatttcttacgttaatcctataaaaaaggcgtgatatttttcacgcctttgtcttattcaaactctaattccaccgcactttcgccgagtaaattcaccaattccgtcagaatttcatctgttggaatgatcgaccattgcacgcctaaacgtaacaacgcacgacctttcggactttgataatacacgttaataggcaatgttccaccactcactggctcaagtaatgctttaaattgtttaatgaaacttggtgtaatttgatgctcagaaagactaatagccaaggatttgacataacgagaacgagcctcatctaaggtcattaactcgcgcaccgtcattttcaagccaccagagaaatcatcaaagctcacctgccctgaagcaacaatcactgtatctttttgtaatttctcaccaaattgttctaggctttcaccaaataatgttaaatctaagcgacctgaacggtcatccaatgttgcaatacctagacgattgccttttttcgtcatcgcaattctcgatgccacaacgagccccgccacagtgctaatttgtccacggcgatttggtgcgagatctttcaaccgcgtcgatgtgtaatgggaaagttctttcaaataacggctaacaggatggctacttaaataaagccccaaggtttctcgttcgccatcaaggatttgtttttcggtataaggcggtgtattagcataggcattttccacgtcttcatgggtttcagtcagcacaccgaacatatccgtttgtcccattgcttcatctttcgcatgctgatcggaagctctaagtgcatcttccaaattcttagaaagtgcggcgcgatgtgggcctaatttatcaaaggcacccgacataattaggctttcaaaagtacggcggttaatttttttcaaatctacacgagcgcataaatcgaataaatctttgaaaatccccccttcatttcttgccgccacaagtgcttcaatcgggccttcccccacgcctttaatcgcgccaatcccatacacaatttcgccttgttcattgacactaaaatggtgttttccgatattaatatctggtggcgtcacttttaagcccatacgcaaacattcgtcgtataaacctacgattttatccgtattatccatttctgatgtcatcactgcagccataaattctgcagggaaatgagttttaagccaaagagtttggtaagacaccaaggcataagcagcagagtgagatttattaaaaccatagccagcaaatttttccaccaagtcgaaaatcttcatagatagctcgccatcaataccgtttttctcagccccctctttaaacactaaacgctgttttgccatttcttctggtttctttttacccattgctcgacgcaataagtcagccccacccagcgtatagccagccaacacctgcgcaatttgcatcacttgttcttgatacaaaataatgccgtaagtcggctcaagaataggtttcaaacttgcatgttgatattctgcgtcagggtaagatacttcttctctcccgtgtttacggtcgataaagttatctaccatacccgattgtaacggccccggacggaacaatgctaccaatgcgataatatcttcaaaacagtcaggttgcaggcgtttgatcaaatctttcatacctcgtgattccaactggaacacggcggtggtttcggaacgtttaagtaattcaaaagattcaggatcatcaagtggaatggcggcaatatctactcgaggcttgccttcacgcaccatacgaacattaattatatccaatgcccatttaatgatagtaagagtacgcaagcctaggaagtcaaatttcacaagccctgcatattccacatcatttttatcaaagtgagtaactggatgtaagccttcattatcacaatagagtggtgcaaaatcagtaattaaggttggcgaaatgaccacgccacctgcatgtttacctgcattacgtgtcacaccttccagcttgcgcgccatgttaatcaatgctcgcacttcttcatcgctatcgtaggcagtctgtaattgcggctcggtctcaaacgctttggcaagcgtcatacctggatctggcggaatcaatttagaaatacgatcaacgaaaccataaggatgccccagcactcgccctacatctcgaataaccgctttcgccgccattgtaccaaaggtaataatttgtgataccgcgccacgaccataggtttctgcaacgtgctcaatcacgcgatcgcgaccgtccatacagaaatccacgtcgaaatcgggcatagacacacgttctggatttaagaaacgttcaaatagcaaatcaaactctaacggatctaaatcagtgatttttaatgcataagccactaatgaacccgcaccagaaccacgacctggccctactggaatatcgttatccttagaccattgaataaattccattacgatcaagaaataacctgggaaccccatttggttaattacatctagctcaacttgcaagcgttcatcatattttggtcgtttttctaaccgcactttttcatcagggaataaaaaaactaaacgttcttccaagccctctttggatttttgcactaagaaatcttctgtacttaaatcgccagttggaaattgaggtaagaaatattgaccaaggcgcaaagtcacactacaacgttgcgcaattaataaggtattttcgagagcggaaggaatgtctgcaaacagcttacacatatcttcttcactacgaaaatattgctgtgaggtataacatttcggacgtttaggatcgtctaaagtatagccatcgtgaatsstacgcgaatttcgtgggcttcaaaatcctctgtattcaaaaacatcacatcattagttgcgaccaatggtaaatcacaacgttctgctaatttcaacgctgcttgaatgtaacgttcttcatttgggcgacctgtacgacttaatgctaaataaaaatgatcggcaaaaaattcttggtaaaaagcgaccgcactttcaatttcggctacgttttctttcaacaattttttacccacatcgccttgcgttccccctgataaaataatcacgccgtcgcgatgttcaattaaccaatcttgatcaatataaggtaaatcgttataaccgcgttgataagcctttgataacaataaagtaatatttctatagccttcattatttttagctagcaaagtaagatcaaagtattcatcgccacataatgggctttttacttttacatctgccccgataatgggcttcatacccgaagaaagcatttcgctataaaaactaaccacaccacaaaaattagtaaaatccgttaatcccatagcaaccatttcattggcagcacaagctttcacaagaggtttcactttgacgatactgtcaatcatcgaaaaatctgtgtgtgtgcgaagatggatgaagcgaggttgggatgacattgaaaatccttaaagtgcggttaaattttgccgtaaatattaaagcggtattatagcgaatttttcaaacaaatgcttatgctacaaatagtgttcccaaattggctcggataaccgattgcgtgaataaaaaatgttaagtagatcaaaaaattgataattagccgttttcatttngttagatttccgctagtctaacgacgattttttatttatttcaacgaataaggataacgctatgacaacactttnggaggttgcacaacattggttaaaccaagatcctgacgcagnaaactcgtgcagaattaaccgcacttttagatgccgcaaaaggcggagataaagcggcagaagcagaattacatgcgcgttttgatggtcgcttacaatttggtacggcaggtttacgtggtcgtttacaagctggctcaatggggatgaaccgagttttagtttctcaagctgctggtggtttagcggaatatttaaaaggttacgataaagaaccctcaatcgtcattggttacgatggtcgtaaaaactctgatgtttttgcccgtgacaccgctgaaattatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggcttaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgctaatgacccagatgcagaccgtttagccgttgctgtgcctgatgcgcaaggcaactggaaatcactacacggtaacgtggttggctgtttcttaggttggtacttagcaaaacaatatcaaggtaaacaaggcacattggcttgctcacttgtttcttctcctgcgctcgctgaaattgcgaaaaaatacagtttccaatcagaagaaaccttaactggtttcaaatacatcggtaaagtatctggcttattgttcggttttgaagaggcattgggctatctagtggacccagacaaagtacgcgataaagacggtatttctgcagcaatcgtgttcttagatcttgtgcgtaacttgaaaaaacaaggcaaaactttagcagattatgctgatgaatttaccaaagaatttggtgcttatgtgagtggacaaatctctattcgagtcagcgatctttcagaaattggaaaattaatgaccgcacttcgtaacaatccaccagcagaaatcgctggcgtgaaagtggcacaatttatcgaccacattaaaacagatcgtcaaagcgatatccttgtatttaacttggaaaatggcggacgcttaattgctcgtccttcaggtactgaaccaaaaattaaattctacttagatgcgcgcggtaaagatccaaaagatgcagatcgcgtactagcagaatttgatgaaggtgttcgtcacattcttcgccaagatgcttatggcaaacaagactgctaattgcaaaatagtaagaaaaaacaccgcttgtaaaagcggtgtttttgcatttaagcacttttgctgtttaaaattttccctaaattcgtttccaaccaatccaccaactcaaacatcttattagattcctctctcccaaattctgttaatgtgtaatctacttgtggcggaacagtgttgtaggatttgcgaattacgtaatggttggtatacagaaaactacactgaatcagttccaactacattagcaaacaatgctttctatggttcagtagaaaacggaaaaatttcatccgcacttcgtgcagaacttgctgaagctgcagcggattatgccgtagcacttgtacaagtaggattaggtgaaggctttgcaggcttaattgcacaatgggatatggatacgtcaaacggtgcattgacttgttgtttgaaaagggtgtggtatttggtcataaaaaatctgcaccttagttagttggttatttaatccagcttttggggtgcagatcattcctagcttgccttttgttttaccatttaattaatgtttagtttgttcttcctcagatttttcttctgcattttctgcttgttggcgattcatatattcaacaaacaatgcatcaaagtttactggagataagtttaatgcagggaacgtaccgcgatttactaggttagacactaattcacgcgcataagggaaaagcatattcgggcattgagaagttaaacaatgcgccatttgaacatcttctaaaccgctaatagtaaatacgcctgcttgtttaacttcgcaaataaatgcgacatcgccactatcttcaagtgtagtttcaacagaaatgtttaataccacttcatataagtcatcgccaacttgggttgtttcggtgcttaaatcaaaaccaagttttggtttccattcttgttggaaaatatgtggaagatttggagcttcaaaagacacatctttcacataaatacgttgaatttggagaacgggttgttgttcttctgttgctgcaacgtcttgtttttgntctgacattttctattccttattatttatgttttttaactaaaggtaaatttgctgctacccacgcggaaaggccttctttcaacacaaatacagaattaaaaccttgtttggttaaaaatactgcagaagcagaggctgaagtaccatttgtatcgactaatataagagcgttctctttatgcgactctaattttccgatattttgatttttaatttcgcttggaagcacattaatactattaatgatatgtccacgttgaaattcttcaagactacgtaaatctaccacaatggcttcatcggaatttattaaccgaataacttcattgtgcgtaattactttaaatttactcgttgcgcctttgtagaatgtataaattaccattacgaaaatcgcaaaccaagaaactgctaaaagcgtatgtttttgagcaaactctgttgccattgagataaattcttgcattgttttctctactgattaagtacgtcaaaatagggctcaagtataaccgcacttgggttatctttcaaaaaaattatgcttaaattccgtacttgcataaaggttatacaatcaacaaaaaaaattatgtgatcgagatcataaatttgtttttccattgtttataaataacttaatttagttagactactttggagaaatttttattcatcttaggagaaatctatgaaattaactaaattagccttatgtactttatttggtctaggtgtttcaatagcaaatgcagctgacttaccaaatattacaatcttggcaacgggtggtaccattgcaggaagcgggcaaagttcggtaaattctgcgtataaagctggacaattaagtattgatactttaattgaagctgtaccagaaatgaaaaatattgccaacattaaaggtgagcaaattgtaaaaataggttcacaagacatgaatgacgaagtctggctaaaactggcaaaagccatcaatgctcaatgtaaaagtactgatggatttgtcattacccatggtacagataccatggaagagacggcttatttcttagatttaaccgtaaaatgtgaaaaaccggttgttctcgttggggcaatgcgtcctgcaacagaaaaaagtgctgatggcccattaaatctttacaatgctgtcgttgtcgcagcagacaaaaaatcaagtggtcgtggtgttttagtcgcaatgaataatgaagtactaggtgctcgcgatgtaacaaaaaccagtacgaccgcagtgcaaacgttccattcaccaaattatggttctctaggctatattcataacagcaaagtggactatgaacgttccccagaaagcaaacataccatcaacactccgtttaacgtagaaaaattagatagcctacccaaagtggggattatttatgcttattcaaatgcacctgtcgaaccattaaacgcattactcaatgctggctatcaagggattgtatctgcaggagttggcaatggaaatgttaatgctgcacacttagatcgcttagaaaaagccgcaaaagatagcgtcgttgtagtccgttcttctcgtgtaccaacgggttatacaactcgtgacgctgaagttgatgatagtaaatatggctttgtagcatcaggtactttaaatccacagaaagcccgcgtgctcttgcaattagctttaactcaaactaaagatccnaaagtaattcaacaatatttcgaagacttctaagatcaatggtaataaacaaagtgcggttataaataaccgcacttttgaccacaatttattgatccaagttatggaatctctacctatttgttgctatattacacgccgtttcaacaaataaaacacagtgttttttattaacctaggggggcagtatgtctgcaatgtttttactacaatttgccatcgtattattgtgtatctttgtgggtgcgcgtgtaggtggtatcggtttaggtgtatttggtggtttaggtcttgccattctttcttttggctttggcttgaaaccagcaggtttacctattgatgttatgtttatgattatggctgtagtggcagccgcggcagcaatgcaagcagctggcggtttagactacatgatcaaaatcgcaaccaaaatcttacgtcgtaatcctaaacacattacgtttattgcgccagcagtaacttggttattcactctcttagcgggtactggtcacgtggcatattctgtattgccagttatcgctgaagtgagccgtcaaaacggtatccgtcctgaacgcccaatgtcaatggcggtaattgcatcacaatttgctatcgtagcaagcccaatcgctgcagcggtggtggctgtggttgcttaccttgagccacaaggtattcatcttggcgatgttttaatggtaaccattccttcaactattctaggacttttccttgcttgcttatttgttaataaaatgggtaaagaattaaaagatgatccagaatatcaacgtcgtttgaatgatccaaaatatgcagatatttttgcttctaccacttcagtcaaagaagtagaagtgagcaaaacagctaaaatttccgtttctttattcttatttggtgctttacttgtcgtgttaatgggtgcagctccttctattcgacctgtttttgatggaaaaccaatgggaatggcacataccattgaaattattatgctttctattggtgcattgattatcttaacttgtaaaccagatggcacagcgattaccaaaggttctgtattccatgcaggtatgcgtgcagtaatcgcaatcttcggtattgcttggttaggtgacactttaatgcaggcacacattactgaagtaaaagaaatggtgaaaggcttagtggaaactgcaccatgggcatttgctttcgctctatttgtactttcagtattagtaaacagccaaggtgcaacagtagcgacattgttccctcttggtatcgcattaggtatccctgcacctgtattaatcggtgtatttgttgctgtaaatggttacttcttcatccctaactatggtccaatcattgcatctcttgacttcgataccacaggtacaaccaaaatcggtaaatacattttaaaccacagctttatgcttccaggtttattgagcatgtttttctgcttattaatcggtttaggtctttcgcacgttattctttaaaatgtgattcgataacaaagaacggtgctgaaatagcaccgtttttgttgttctaatatcaacttaaaataactcaaaaaaataaccgcactttgatatataagtgcggttatttttatgaaagttttccgccctgtttcgttgttatgttatcattacattaatgtaacatttttaacaatttaaacttttaggagagctttatgaaaaacgtcgtgatcgttggtgggggtgctggcggtattgaattagcaacatttttgggtaataaattaggtcgtcaaaaacaagctaaagtaacgctggttgatcgcaatgccacccatttatggaaacccttattgcatgaaattgcaacaggcgtaatggatgatggcgttgattctttaagttatcgtgcgcacggtaaaaatcattttttcagttttgagcaaggttcaattatacgtattaatcgcgagcaaaaatatgttgaacttgcacctgtttatggacaagagggcgatatgcttgtcattgctcgtcgaattccttacgattatttagtgattgccattggcagtaaatctaatgatttcaacacaaaaggggtggctgataattgtatttttttagatagttcaaaacaggctttacgttttcaacataaactgttggaattatttttaaaattttcagaaaaccgcgcattagatgacattggcgaagaagaatttaaacaaaagttagtggatgaaaataaagtaaatattgctattgtgggaggtggagcaactggtgtggaattaaccgcagaactttatcatgccgctgaagatttgtcttcttacggttatggtaaaattgatagttcttgcttacaagttactttagtcgaagcaggaacacgtttattgccagcattacctgaaaatttatctgctgcagtgttagatgaattaaaggaaatgggcaccaatgtgcaattaaacacaatgattactgaggcgcagccaaatacacttattaccaaagatggcggggagattaaggctgatcttattgtttgggcagcaggggttcgcgcctcaacagtaacgcagcaatttgatggattagaaattaatcgtatcaatcaattagtggttaaagatacacttcaaactaccgttgatgatagtatttttgcgattggcgattgtgctgcattaatacaatcaaatggtaaattggttccgccaagagcgcaagctgcacatcaaatggcaaaggcttgtgcaaaaaatatttttgcattgtttgaaaataaaccactgaaatcttttaaatataacgataaaggtactttagtttctttgtcaaattttaccgcacttggtagtctaaccaataagtttggtaaaaatccacttaccgttcaaggtaaatttgcgcagtttgcttatgtgtctttgtatcgaatgcaccaacatgctttgcacggttgtattaaaattggtttgattattctcgttgataaattgaatcgttatttaaaaccaagattaaaattgcattgattaagtataatttttcgttaaatgcgatctaaatcatttatataaaagaaagggcatcaatgatgccctcagtattgttttatgaagaaagatcttcggatttttcaattgttcctttcaccgttaagcaaatttctgttgaaatcaaatgggaaagcgttgaagctaattcttctattttatcaagaacagtataaccagattcatcaaagtaacgttgctctttcaagtttgcaataaagcttgaaaaaaccgctttatcaaagaattctggtgcatttatgccgtgtaatactgataaacgttgagcaacaagctggctttctttttcaagttcagctcgagaaatagcaggttgtttttgtaaaatagtgacagtaatgtaataacgttgcaagatttccagcattcccgcagaccaaagctgtaaaattcgtacttttgatttattaatagataagaagttatcatttgaattaataacgctttggcgtgcaaattcattaatgatttgatggatttgtacattcaattcatcttcattgaaatgtaagaacaattcgccttgtaagaaagggtaaatttttctaattgcgtctaataataaatctttttggatcgcttcgtaatgcaaaataatactcgcaactaaagatggtaatacgaatagatgctgaatattattacgataataagtcattagtacagcagatgaacgttctaagcgtacaatttcgccaaaattatctttttcaattaacacacctatacgatctaaagccaatacgtgttctaacattgcttgcggtgtcacatttggtagcactacgtccgtagaataagggacattttgtaacaattgttgataactactaagttgttctaacagttgctcacgtgaaagtgctcgctgacgagatgaaagtagtgctgtacccacaaggttcattgaattaactgccgctgctttgttaatattaatcattacttgtttagaaatattatttaccgcaggtgtaaaccattgtggtttttcttcgtgattttgctctttccaatcaggaaaatgttggctcaaatagtttgaaagcgtaattggctcaccaaaatttacaaaaccttgaccaagattacgtaattttttaattacacgaagtactaaacccgcattttctttttctttcgctgcaccacgtaattccttagcataagtgtctacttctaatacgtgttcataaccaacgtaaacaggaacaatcgaaatggggcgagtttgactatgttgcaatgcttgaagtgtcattgacatcatacctgtttttggtgccagcaaacgacctgtacgagaacgaccgccctcaataaaatattcgacggaatagcctcgatggaatagttctgataaatattcgcgaaaaatggcagaatatagtcgatttcccttaaaagtgcggcgaataaagaatgccccccaactacgaaacattctacctataggccagaaatttaagttaatccctgccgcgatatgtggcggaacaagaccttgatgataaagcacataagaaagcaataagtaatcgatatgactacggtggcaaggcacataaacaatttcatgaccttctaacgctaatttacggacacgattcgaattttgtacattaatacctgaataaagtttattccaaagccaacgtaaaaaacgatctactgcacgtaaacttgaatggctgacatcagctgcaatttcatccaaaattttatatgcttctttttgtgctttttcaatactgatattttttgattttgcttcatcttcaattgctcgtcggattgcttctgattgcaataatttattaaacattgcttgacgatttggtaaacgagggcctgtcgctgaaatacgttgttttgcgaagtgcatttttgcaactcgagccagcttttgtgcaattttttcatctgagccatgttcaactaccatataacgtaatgaaaccgcttgagaaaaacgcacaaaagtatcacgtccaaaccaaattgctgcaaatgttttttgtataccatttaataaacgcaaattaggcaaatctgatttatcttcttgtccgggagaacgtccccaaagaacagaaacaggaataagttgcacatctaaactttcagaagtgcggtgtaattcaagatatttattgaaaatggtagtggtttcgtctttcgcaccttttgatttaaaaattcggcgaccttcgtctaaatatacataacgtggtaacttaacgccattaatttcatttttctctgcgggatcgggcaagcctaacgctaagcaatttcggcggaaaataacgaaatcagtttgagatgtataaggcaaaacataaacaataggttgatgaatattaagtgaaagctcttctattggattggcgggaataggattatttttcaccaatgcagacagcggcaagctcaataattggcgatacatatttataaaatttgccataataaattttctctttgttataagtttgtagatcttatagacgtttaaaaagcagtttgtgaatagaactatttttagccctttggtgtttttatcgtccaaaaactcaaatattttaacacatccgatctcaactaatttagaaaatttggcgacaaaatgtgacttaatacacagatttaaaaaataacagttgcaactttacacaatctgtatacaataccagttatctgtgtttaaaaacaggagtgtatatgagaccattaaccgcacgccaacaagaagtgttggatttattaaaacgccatttggaaacaacaggtatgccaccaacacgagcagaaatatctcgagaattaggtttcaaatctgcaaatgccgcagaagaacatttgaaagcactttcacgtaaaggtgcaatcgaaatcattcccggcgcatctcgtggtattcgtattttagacaatagttcgaatgatgaatttgacggtttaccgcttgtagggcgcgtacgtgctggagaaccgattcttgcagagcagcatattgaagcgacatatcgagtagatgcagatatgtttaaaccacaggctgacttcttacttaaagtttatggtttatcaatgaaaaatgttggtatcttagatggtgatttattagctgtgcatagtactaaggatgtacgtaacggacaaattgtggttgcacgtattgaagatgaagtaacagtaaaacgtcttgagaaaaaaggttctatcatttatctacacgcagaaaatgaagaatttgatcctatagtagtcaatcttgaagaacaaaaaaattttgaaattgaaggtattgcagtaggcattattcgtaataacgcttggatgtaatctgataccaaggaatgaataaagtgcggtaaaaatttacggtatttttaccgcactttgcttatactagagttctttatttgccatgatttttgctgctctttataatgcaaaaatcttgaatttatacaaaggatggaaaaatgcagttttccaaaatgcacggattaggtaacgattttgttgtggttgatggagtcactcaaaatgtgttttttactccagaaacgatccgacgtttagccaatcgccattgtggaattgggtttgatcaacttttaattgttgaagctccttacgatcccgaactcgactttcattatagaatttttaatgctgatggaagcgaagtttcgcaatgcggaaatggtgctcgttgttttgctcggtttgtgacattaaaagggctaactaacaaaaaagacatctcggttagcacacaaaagggtaatatggttttgacggtaaaagatgacaatcaaattcgtgtgaatatgggcgaaccaatttgggaaccagcaaaaattccatttaccgcaaataaatttgagaaaaattatattctgcgtacagatattcaaaccgtactatgtggtgcagtttcaatggggaatcctcattgtgttgtacaagtagatgatattcaaacagcaaatgttgaacagcttggtcctttgttagaaagccatgaacgttttcctgagcgtgtcaatgctggttttatgcaaatcatcaacaaagaacatattaagcttagagtttatgaacgtggtgctggcgaaactcaagcctgtggaagtggtgcttgtgcagctgttgcagttggcattatgcaaggcttattaaacaacaatgtccaagtagatttaccgggcggttcgctcatgatcgaatggaatggtgttggtcatccactttatatgacaggcgaggcgacccatatttatgatgggtttataactctttaatatttttccccacttatcttaaaaaagatgaggcgtttttcttaaattagcgtaaacattttgtatctaaatatatttttattgaactgtttgataactttaagtaatcagaacaagcatttttcatacaatctctagattttttactcaaagaaatagattattagcataataaaaaaaccgcctctcggcggttcttgttttaaatcttctatctactacgctaacactgccaatgcagcttcatagtttggctcttctttaatttcttcaactaactggctgtgtaaaacattgttttgttcatctaacacaataaccgcacgagaagttaaacctgccaacgggccagtttgaatatctacgcctaattgtgagtgtaatgcgtggttacgaaaagttgaaactgttttggcattttcaatcccttctgctccacaaaaacgagcttgagcaaagggcaagtctgctgaaatacaaagcactatggtgttacttaattttgccgcttgttggttaaatttacgtactgaagtcgcacatacacctgtgtcgatgcttggaaaaatatttaggaccttgcgtttacttgcaaaatcgtttaatgcaacatcggctaaatcattaccgactaaaataaagttttctactatttcgcccacttgagggaaatgtccgccaacttcaatagggtttcctgctaatgtaactgtcataaaatcctctttatttagattaagtgaaaagtgtttaaactataccacgctttctaattctttccaccaattaaagctatccagaatttgattttcgggaaaatttcagccaccacacaataaccaatagcaaagactaatgaaaacagtatgtgcgttaccccaatccagttaaatccgtgaaatcaatagggctgcgcggtggaaaagaatgctccgctccccatttaacgaaagcagagataaaacctgcaaaaaattgcaacgccctaacgacgtttagatggttctgaaaataagctcattgttatgtccttaaattaattaaaagtataaaaatttccgagtttatgaaagtgtgtaattttacgtctgttatatcacattatcaaacaaaaatacttcaattgggttatctttggctggctgttcataaggttttaaaatttattagcaatagataaagtaattgattgattttttagcggttgtagagagggtataagctttgtattacaaaatcttttttttgaaaatagggagtatgtttgaacataaatcttattgttttattttgaatgcaaacgtttgctttgttcgttataatacgtctgtttttttatttttcttttatacggaactgcaatatgactgtcaaaacctttcgtggctcgcctgctctttctgaatttcgtttaactcaacttcaacaaaaatgccagcaatatcaattgcctattacgtcagtttatgcagagtatttgcattttgttgaacaaaaaacatcgcttgtagaagatgaaatcgttaaattacaagcattattgcattatggatcaatgttttctgaactcaagcctgcaggatattgtttaattgtgactccacgagtggggacaatttcctcttggtcttcaaaagcgacggacatcgctcacaattgtggtttgtcgaaggtaaatcgtattgaacgtggtatagcctattacttcaatattgagcgtgatttaaccgaagcagaattggctacgctgaaagatttattacacgaccgtatgttagaaaccgtgttaaatcacgaaacagaagcagccttgctttttactcaacaagaacccaaagcattaactacaattgatattttaaatggtggccgtcaagcattagaacaggcgaatattgccttgggtttagcgttggcagatgatgagatggattatttagtggaaagttttactgccttaaagcgtaatccacaggatgtggagctttatatgtttgcacaagcgaattcagagcattgtcgccataaaatttttaatgccgattggattattgatggcaaaaaacaggataaatcgctgtttaaaatgatcaaaaatacctttgagcaaacgcctgattttgtgctttctgcttataaagataatgctgcagtaatggaaggttcgaaagtcggccgttggtttcctgatcctgatggacaatatcgtgttcatcaagaagatgtgcacattttaatgaaagtagaaacacataaccatcccacagcaatttcgccatttcctggtgccgcaacaggctctggcggggagattcgtgatgaaggggcaacggggcgtggggcaaaacccaaagcaggtttaacaggtttctcggtgtctaacctcgttattccaaactttgaacaaccttgggaaaatccattgtctaaaccaaatcgcattgcttctgccttagatattatgatagatgcgcctttaggtagtgcggcatttaataatgaatttggtcgcccagcattattaggttatttccgtacttatgaagaaaaagtaaatagttttgctggaaaagaagtgcgcggttatcacaagccgattatgttagcgggaggaatcggtaatattcgtggcgaacaggttcaaaaaggcgaaattccaatcggtgctaaattgatcgttttgggtggggcagcaatgaacatcggtttaggtggtggtgctgcttcttcgatggacagtggtaaatcaaaagaagatttagattttgcttctgttcaacgtgaaaatccggaaatggaacgccgctgccaagaagttattgaccgctgttggcaattaggcgaagaaaatccaatcctgtttattcacgatgtgggtgcgggtggtttatctaatgcaatgcctgaattggtacacgatggcaagcgtggaggaaaattcgatctgcgttctattctttgtgatgaaaaaggtatgtcgccattggaaatttggtgtaatgaatcgcaagaacgttatgtattagccgttgcgccagaaaacctcgaattatttaccgcactttgtgagcgtgaacgtgccccttttgcagtgattggcgaagcaacacaagcagaacatttaatcttgcacgatagtcatttcgataataatccaattgatttaccaatgaatgtgttattaggcaaaacgccgaaaatgacgcgtgaggttttgtcaaaaacagtggaaaatcaatcacttaaaatagaaagtattcaattaaaagaagcattccaccgtgtattacgtttacccgttgttgcagaaaaaactttcttaattactattggtgatcgctcggtaacaggaatggtagcccgagatcaaatggtgggtccttggcaaatccccgtgtctgatgtggctgttactactgcttcactggatagctaccacggcgaagcaatggcaattggcgaacgctctccagttgccttgctagatttctcggcttcggcacgtttagctgtggcggaggcgattactaacattgctggcaccctaattggcgagatgaaacgtattaaactttctgccaactggatgagtgcagcaggtcacacaggcgaagatgctggactttatgaagcagtaaaagctgtgggcgaagaactttgtcctgcgttaggcttaactattcctgtgggtaaagactcaatgtcgatgaaaaccacttggatcgataatggcgaacaaaaatcagtgaccgccccgctttcattagtaatttccgcttttgctcgtgtagaagatgtacgtaaaacgcttacgccacaacttcgtaccgacaaaggtttctcgagtttattgctaattgatttaggcgaagggcataatcgattaggtgcgaccgcacttgctcaagtgtacaaacagttaggagacaagcctgccgatgtggtaaaggttcaacgcttaaaagatttttacaatgcaatgcaaactttagtggcagaagataaattattggcttatcacgaccgttcggacggcggtttaatcacaactcttgcagaaatggcgtttgcagggcattgtggggtagaagttgatatttcagctttaggcgacaacgatttagcggtattatttaacgaagaattgggagcggttatccaagttgccgatagccaattagaaagcgtacgtgaggtgttgaaagctcacaatttgcttggtattatccaccaattaggtacggtaactgctgatgatcgctttgagatcagccgcggcagccataaattattcagcgaaaaacgctctgaattacgtagtatttgggcagaattaacttaccaaatgcaacgcttacgcgataatccagagtgtgctgagcaagagtttgaagctaagaaaaaccctgacgacaaaggcttatccgcatttttgacttacgatgtgaatgaagatattactgcgccatttatcaataaaggtgtaaaaccaaccattgcaattttacgtgaacaaggtgtaaatagtcattatgaaatggcagcagcgtttgatcgagcaggctttaatgcaattgacgtgcatatgtctgatttaatgattggtcgtcgtaatttagccgaattcaatgcaatggttgcttgtggcggtttctcttacggcgatgtgcttggcgcagggggcggttgggcaaaatccatcttatttaacccgaaattacacgagcaattcagccagttttttatcaatccaaacacactgaccttaggcgtatgtaacggttgtcaaatgatctctaacttggcggaaattatcccaggtacagaaaactggccgcattttgtacgcaacaaatctgaacgctttgaagcgcgtgtgagtttagtgaaaattaatgaagtggattcagtttggtttgcaggaatggctggctcacatatgcccattgcggtttctcacggggaaggacaagttaagtttaaatcagttgaacagtttgcaggcttaaaagcacaaggcatcattgccgcacaatatattgacaacaacggtagccccaccgaactatatcctgccaatccgaatggttcttcggagggcattactgcaattacaaatcttgatgggcgagttgctattatgatgccacaccctgaacgtgtgttccgtgctgtgagtaactcttggcacccagaaaactggacagaagacggtgcgtggatgagattattcagaaatgcaagaatggtattttagagaaataaatggacttgaaggttaaaaaagtgcggtggaaatctggcagattttcactgtgcttcggtgttttcaattttatgtaattgtttttagttgtgtttttgtttgatgatttaattatttttattgttaagttagcgatataatcatcaaaatagaaatatagaaatgattaatatgaaacctcaatattatcttggtatgatgtcgggtactagcttagatggcgtggatattgtgttggttgatttttctcaagatcctcaacttatcctatctgatttttttcctatgccagaagatttgcgtgagaaattaaccacacttattcaagtaggtgaaacaactctacaaaatttaggcgaactggatcataaacttgccttgctatacagtgattgtgtcaatgcttttctgcagaaaaatacttttttgccaaatcaaattcaggctattggttgccacgggcaaacggtatggcattctccaaattcacaatttccctttacaatgcaattaggcgatatgaatttacttgccgctaaaacaggcatttcggttattggggattttcgccgtaaggatatggcttggggtggacaaggtgcgcctcttgtgcctgcgtttcacgaggcggtattttcaaattctaattttgctacagctgttttaaatattggcgggattagtaatgtgtctattttgtttccaaatcaagctgtcatcggctttgatacaggtccaggtaatacattattagatcaatggatcgaaaaacatcaagggcttcgttatgatgaaaatggcgagtgggcagcaaaaggcaacgtgaataaagttctgcttgatgaattactcaatgaacctttcttttctttacctgcacccaagagtactgggagagaattatttaaccttgtttggttaaatcacaaaatagcaaaaataagggaaaaattgaccgcactttcagttgaaatgtcttttcgcccagaggatgtgcaagcgacgcttgttgaattgacggtaacaagcattgttaatgcactaaatcagctccaaacagatttaccaaaacgtttactagtatgtggcggtggtgccaagaatagcttaattatgcgtggattgcatgataatttactcgattggcaggtcagcacaacgacagagcaaggttttgatattgattatgtcgaagccgctgcttttgcttggttagcttattgtcgaatcaacaatttacctgcaaatctaccaagtgtaactggggcaaaaagtgcggttagtttgggggctatttttcctaaagactaaggtcaaaatatgaatgacattatattaaaaagtttatccacattaattacggaacaaagaaatccgaattcagttgatattgatcgtcaaagtacattagaaattgttcgattaatgaatgaagaagataaacttgtgccacttgcgattgaaagctgtttaccgcagatttcgttggcggtagagcaaattgtgcaggcttttcaacaaggcgggcgtttaatttatattggtgcaggcaccagtggtcgtcttggtgtattggatgcgtcagaatgccctccaacatttggcgtgtctacggaaatggttaaaggaataattgcaggtggtgagtgtgctattcgtcatcctgttgagggtgctgaagataatacgaaagcggtgcttaatgatttacaaagcatacatttttcaaaaaatgatgtattagttggtatcgctgcaagtggtcgcacaccttatgttattgcaggtcttcagtatgcaaaatcgcttggtgcattgacaatttctattgcgagtaatccaaaatctgagatggctgagatagccgatattgcgatagagactattgttggccctgaaatattgacgggttctagccgcttaaaatctggcacagcacaaaaaatggtgctgaatatgctgactacggcaagtatgattttattgggtaaatgttacgaaaatttgatggtcgatgtacaagccagtaatgaaaagcttaaagcccgtgcggtgcggattgtgatgcaagcgaccgattgcaataaaacattagcagaacagacattacttgaagcagatcaaaatgccaaactggcgattatgatgattttaagcactttatcaaaatcagaagcgaaagtattgttagaaagacatcaaggtaaattgagaaatgcgctttctaaataagacaaaaacctgattgtaaaatcaggtttttattttggaattccacgcaataatcctacaggctcaaaaggttctatagaagttggtgcaggcacttcgctgaataataaaataaatggcttgggcgggattactttttcattacgccataagttgcccattccgactaattgaatatcttcgggtaaattacgaagacctgcttgtaaaacagcaatcgtatttggacgaggatgacctattgcaatggcggagccgtgttttctagcatagtgaattgctgctttaaattgacgttgaacgtctgcgaattcgttactatcatctaaaaatatatggcgatctaatgaacgcacgccttgttcttttgctattttcccagctacagattttcctattgttcgactatctaaaaagaacaagtgtttttcttgaagtgcggtcattaaataagtcattaattggggatctgccgtagctgcactccccatatgattgttcataccgatggcatcacgcacaatatttttagccgtattaacgcgatcatttacttgtgccgcagacattcctaaatgcagcccaccgtcttctattttcactgcacttactggttgcatcggcatatggattaaaatatctctaccttgagattttgcttcttgattacgtgctcgagcatagggcgctgcaggaataattgctacggaaatttcacgtggcatcgcaaaaattgctgcatcttctttgagatgatagcctacatcatcaatcacaatagcaagtttactttgagcaaaagaaaaagaggtataaagtgcggtagaaaaaacaatgaaattttttaccgcactttttatcagaatattcatcaacgaacccaccctgcaggatttactggcgttcctttacggctaataccaaaataaagcgcagaacgtgatatttcccctgtatttcctacttgagcaataacctgccctgctgaaacaagctgaccaactttcactgatacagcttgattgaagccatataaacttaaatcagtttcgccgtgtttaacaataaccatataaccataaccatttaaatatcccgctaaaatgacgcgtccagcagcaattgctttaacaggcgtgcctgctgatgcgccaattaccatacctttccaacgtacttcgcctgcttggatagaaccaaaagtatgcaaaattgaaccagaaactggtaaggaatattgtttttttgccgcccctaaaccgcttgtactattaagtaattggcgttcttgcacagttggttgataaggttttgatgttcgtttttcttcagctttttggcgttgagcaagtgcctctctttcacgtttttcttgttcgcgcgctgcttgttcagctcgttgaatttcttgacgaagtgcttgttcgtttgcttttagtgtattcaatttatcttgatctagggctaaatttttattgagttcattcagcgtagattgatgctcttgctgtgctttttgcaatgcttgttgttgttttttttgtgtggaaagttgatttcggtgattcttttgttgagagagaatcgcctttttttgtactgcaatttgtgcttgcgttgcttttaaattattaatcatttcaatccgaacttgatttaaatgctgataataaactttcattcgctctgcttttgtcggatcttgggcaaacattcgttcaatcagcgatggattaatgcctgaacgataaattatatctatttgtttggttaatcgtgctttttgctcacgttcctgtttttctaattgtttgagttgcttatctgcatcggcaatttgcttacgaatttcctttaaacttatttctgtttcaagcagttcgccctcaacactgttaattttactctcgtgtttttttaaatttgcttgtaacttagcttgctcacgtttttgcttctctattttagattcttgttgcttaatttgtttttgaatttgattgagatcggaagattggctgacaggcgaaaatattaataaaccgcagcttaaaagtgcggttaataataatgatgttttttgattaacgccaaaacgcaacataattcatcctaaattcgtaaaactcgcaaatcttatcatatttgttaaaaggcgaaaaagtttgatggttattttttgctaaagatcaggaaatcatcccttttaacttttaaagctaaggattttttgctataaaatgtgcgttctttttatttgaaaaaattaggagattcttatggaattagtatttatccgtcacggttttagtgaatggaatgcgaaaaacttattcacaggctggcgtgatgtgaatttaactgaacgtggtgtggaagaagcaaaaactgcgggtaaaaaactgttagacaaaggttatgaatttgatatcgcatttacctctgttttaactcgagcaatcaaaacttgtaacatcgtgttagaagaatcccatcaattatggattccgcaagtaaaaaactggcgtttaaatgaacgtcattatggtgctttacaaggtttagataaaaaagcgactgcggagcaatacggtgacgaacaagttcatatttggcgtcgttcttacgacatttctccaccagatttagatccacaagatccaaattctgcacacaatgaccgtgcgctacgcaaatattccatctgatgttgtgccaaacgcagaaaatttaaaattaacattagaacgtgcattaccattctgggaagatcaaattgcaccagcaatgctttctggcaaacgtgttttagtggttgctcacggaaattcacttcgtgcgttggcaaaacatattatcggtatttctgatgctgaaattatggattttgaaattccaacaggccaacctttagtattaaaactagatgataaattaaattacgtagaacattactatctttaattaagttcaacgtattgttgttctaactgtataaaacaaaaccccgcaaattagcggggtttttaagcaagtccaaattattttgtgcttggaattttgaaacggctgttgaaacgctcgacacgaccaccagtatcaacaacacgttgtttaccagtatagaatgggtggcagttaccacacacatcaagattgatgtctttgcctaaagttgaacgtgttttgatcacattaccgcaagaacaagtcgcagtaatttctttatattctggatgaataccttgtttcatagaaaaacctcaaaatgaagccacgccgctataggaactttctccccacaccgcgtgagtgaataatacgccataattggcaccaaataggttgcgaattatactgaaaaaatgcagataaacaagctctattttcgtgtaaaatcatcagcatttttaaccgcacttttctttttatgttagcaaaatcttccatcaatgcgccatttgccaaatctgttttagcttggtacgacaagtttggacgcaagcatttaccttggcagcaaaataaaacgctttatggtgtatggctttctgaagtgatgttgcaacaaacgcaagttgcgacggtaattccttattttgagcggtttatcaaaacatttccaaatatcaccgcacttgccaatgcttcacaagatgaagtgttacatttatggacgggcttaggctattatgcacgagcgcgtaatttacataaagccgctcaaaaagtgcgggatgaatttaatggaaatttcccaacaaattttgagcaagtttgggcattatctggtgtgggacgttcaactgctggtgccattttatcttctgttttaaatcagccttatccaattttagatggtaatgtgaaacgtgtgttggcacgttattttgctgttgagggatggagtggcgagaaaaaagtagaaaatcgcttgtgggcattaacggagcaagttacacctacgacgcgtgtggcagattttaatcaagcaatgatggacattggtgcaatggtttgcatgcgaactaagcccaaatgcgatctttgtccgttaaatatagattgtttggcttataaaaatacaaactgggaaaaatttccagctaaaaaacctaaaaaagcgatgccagaaaaaactacctattttttaattttgtcgaaaaatggcaaagtatgtttggaacagcgagaaaactcaggattatggggcggattattttgttttccacaatttgaagataaatcctcgttgcttcattttttagcccaagaaaaagtcacgcattatcaagaatggccgagttttcgacatacattcagccattttcatttagatattcatccaatttacgccgaaatggagagtactttatgcgtagagcaggctaatttagactggcgaaaagtgatggaaagcacaaaagaataccaatcaaacctatcaagtgcggtcaaatattggtatgatccacaaaatcctgaaccgatcgggctggctcagcctgtgaaaaatcttttaatacaatttgtaaggaatcattatggcaagaacagtattttgtgaatatctcaaaaaagaagcggaaggcttagattttcaactttatcctggagagttgggcaagcgtatttttgattcagtaagtaaacaggcttggggcgaatggattaagaaacaaacgatgcttgtgaatgaaaaaaaacttaatatgatgaatgcagagcaccgtaaattattagaacaagaaatggttaattttttgtttgaaggtaaagatgttcatattgaaggttatgttccaccatcaaattagttatctatcctacaatgaaaaaatatttattattggcattattgccttttttgtatgcttgtagtaattcatcgaatcaaggtattaactatgatgaagcctttgctaaagacacgcaagggttagatattctcacagggcaattctcgcataatattgaccgtatttggggcgtcaatgaattgttagtggcaagccgtaaagattatgtgaaatatacagattctttttatacgcgtagccatgtgagttttgatgaaggtaatatcgttattgaaacccagcaagatttaaatcgattacataatgctattgttcataccttgttaatgggagcggatgcaaaaggtattgatttatttgcatctggtgatgtgccgattagctctcgcccattccttttggggcaggttgtagatcatcaagggcaacacattgctaatcaagttatcgcaagtaatttcgccacttatttgattcaaaataaattgcaaacacgtcgattacaaaacgggcataccgtgcaatttgtctctgttcctatgattgcaaaccacgtagaagtgcgtgcacgaaaatatttaccattgattcgtaaagctgcacaacgttatggcattgatgaaagtttgattttgggcattatgcaaacagaatcaagttttaacccatatgcgattagctacgcaaatgctattggtttaatgcaagtcgtgcctcatacagcaggtcgagatgtatttgcaatgaaaggcaaaggtggacagccatcaacgcgttatttatatgatcctgcgaataatattgatgctggtgtatcttatttgtggattttacaaaatcaatatttagatggaattacgaatccaacctcaaaacgttttgccatgatttctgcgtataatagtggtgcaggcgcagtgttacgtgtttttgataatgataaggatacggcgatttacaaaatcaaccaaatgtatccagaacaagtttatcgcattctaacgacggttcacccatcatcacaagcacgcaattatttgttgaaagtagataaagcacagaaaaaattccgtgttagacgataattgaattttttcagataatcaaaaatgctcgctggctaacaccattgagcattttttattaaaaaagtgcggtaaattttaaaatagtttttattatttcgttgttttaataaacatattgatgattaactattcaaatgaaatgttttttccattttttttgcatttagttattgaccgaaaaccgaaaaaatagtttaatacgccccgttgtcaggcagtagcctataacgataacgcctcgatagctcagtcggtagagcaggggattgaaaatccccgtgtcggtggttcgattccgcctcgaggcaccatttcctccttagttcagtcggtagaacggtggactgttaatccatatgtcgcaggttcgagtcccgcaggaggagccaaatttaaaaaagccgctaaagagatttagcggctttttgctttcttatatataaaatatataatcttctctagtcttgtaactataactaggcatcaaaattcaaaatggcgtatcaatgagcgagagccttcttatttttgatgttagcaagcgaccttagtcgcttgcgtttaacttaaagaagaaaaatgagtcgacttttattttggaatagatttatttttcacgatcatcgatggtttgcagcaaataatttccctctgcatcagcaagactgcggaaacctacattcgtgattttgtagggatactttgttcgataagtaaagttttcgtgatgatgtccgtggaatactagcttaacccccatcttcattgccaaatcattaattacttggaaacccatcggatgtggtttaggggcttcgtgacaaatcaacacatctgcttgttggttttctaagatttcaatatctgatggaaaaattgacgtgcgatgacgcaaaggcacaccgcctcgccaaatcttctcctgtgggctatattggcaataatgaataggatcaaaaaacatggggcgatttggtggcatccaaatttgcccgcggaatacaccgcctaatcccgcaatgcgagttccttgaatatcaactacgcgattgtgtaaattgcgtgattgccactcagagccccaaattgaatcaaaagcactaatggttttgctatcatgattaccatgaataaaccaaatatcacaatgtttcgcaagtttatccaactcatctgatgtcgtgagctgtaaatcgcctaaaattatcagtgcgacattttcctgttcttttataaaagggtaaatgtgatcatagcttccgtgcggatcaccagcaaataaaatcattgagatgtcccttttataggaaaggttgtgttttgtaattcactgatttcctcttcatttaacactttctcaatgactgctttaacttggttatagcgatcaagataacttggtgattcaatctctatataaggaactttatatttatctaacagttttttgagtagttgttgaaattgttggcgttgtttttgtgagcctaagctacgcaagccatcatccacccattcagtattgtttttaagtaaaatagtgacatcgaagggatattctttaatcattgagtctaaaaatggatgggcttttccttcatattgaatgcagaatgcttgcgtggtgatgaaatccgtatcaataaatgcaattttatgagaatggcgcacggcataatcaatgtatcgttgatgaccaagcgccatttgcggatagtcagaatattgcatcgcttgctcgtcgccaccgagcttttcaaatacaaattcacgcccgtattcccacgcagaagtggtattaaatacggcggctaacttattaactagcacgcttttaccactgctttctccccctaaaatcgccaccgttttggcaaagaaaggacgagcttctttcggaataaacttccaatattggaatggagtggtgcgaattttggtggcggacacattaaagaaagtgcggtcaggatcgactaacgaaacttctaaacctaagtatttctcgtaaggcgctttatcttgaggttcgctactaaatacgattgaaggctcaaaatgtttttcatgaaatagggttttaactgcttcactccaagattgccagccgtttggataactcggaataccgtcttcaaccaaatgatgaataaaaatctgatttttttgatatttgaaaatttgctgcatccaacgcaaacgatcttgcacggttggcatgcgtttcattttactatcgtaaaataatttcaaatcgcgcacagtgtcactacacacgataacgtgtagttcatcgactttactgaacgcttcataaatcatatttatatgacctgtgtgtacaggataaaatttcccgaaaatgacaccgacttttttctcttttgtttttgacataatctgctcttgatagcgtaagaattgagtgtgtttattgtaggctaaatgaaaatatttttcacgttctgatttagtgcctaggtattttgcgttatacttagctcgcattctcagggcagggtgaaattccctaccggtggtaaagcccacgagcgtttaaaagtgcggtcaatttttggcaaatttttcctgcgaaattgtcctgattttcacttttaaagtcagcagatttggtgaaattccaaagccgacagtaaagtctggatgaaagagaataaaacgagttgggttcccaaatcgtttattttatttgcatttctcagccctgattctggtatttaattgaaatctcaaattaggaaattactatgaatcagtcaattttatctccattcggcaacaccgctgaagaacgcgtacttaatgcaattaatgcctttaaaaatggaactggcgtattagttttagatgatgaagatcgtgaaaatgaaggcgatttaattttcccagcagaaacaatcacgccagaacaaatggcaaaattaattcgttatggcagtggcattgtttgtttatgcattactgatgaacgttgccaacaactcgatttaccgccaatggtagaacacaataatagcgtaaacaaaacggcttttactgtaacgattgaagccgcaaaaggtgtttctacaggcgtatctgccgcagaccgagtaacaaccattcaaacggcgattgcggataatgctgttctgacagatttacatcgtcctggtcatgttttcncacttcgtgcagcaaatggtggcgtacttactcgccgcggacacactgaagcttccgttgatttagcacgtctggcaggatttaaagaagcaggcgttatttgtgaaattactaacgatgatggcacaatggctcgcgcccctgagattgtagaatttgcgaaaaaatttggttattccgtgctaaccattgaagatttagttgaatatcgtttagcacataatatttaaaatgcaaaagtgcggtgaaaatttctatgatttttttaccgcactttttatattatactgttccaactttttatttatttgggttacttattatgcataatgcagctcagcacaattatgttatcagtttaactactgaacaaaaacgccgaaaacatattaccgaagaattcggtaagcagaatattcctttcgaattttttgatgctattacgcccgacattattgaagaaaccgctaaaaaatttaatattacattagatcgctctcctaaagccaagttgtcggatggggaaattggttgtgcattaagccatattgttttatgggatttagcattagaaaataatttaaactatatcaatatctttgaagatgatattcatttgggggaaaatgccaaagaattattagaaattgattatatttctgatgatattcatgttttaaaattagaagcaaatggcaagatgttctttaaacaaccaaaatctgtaaaatgcgatagaaatgtttatcccatgacggtaaagcaatcaggatgtgcaggatatactgttacagcaaaaggggctaaatatttgcttgaattagtaaaaaataaaccacttgacgtggcggttgattcacttgtttttgaggattttttacattttaaagattataaaatagtacaactttctcctggtatttgcgttcaagattttgtgttacatccagataatccttttgaaagcagtttacaagaaggacgagatagagtacacggaaatcaacgcaagtcctctattttagaaaaaataaaaaatgaatttggacgagtaaaaataaaaatgtttggaaaacaagttccatttaaataataaaagtgcggttaaaaatcttattaaattttaaccgcacttttttgtttattttacttctggtaaatttaccgcacctttatagcctaattgtcgccacgcttcataaaccgttactgcaacagaattagacaagttcatactgcggctattggcagtcattggaatgcggattttttgttccatcggcatttcatttaaaattgacatcggaatgccacgagtttctgggccaaacattaaataatccccaagtttaaatttcacttggctatgtgctggacagccttttgttgtaagtgcaaaaaggcgtttgggtttttcgctttctaaaaaggcttcaaaggttttgtggcgtttgatttccgcaaattcgtgataatccaaacctgagcggcgtaagcgtttatcatcccaagtgaaacctagtggttcaattaagtgcaagcgaaatcctgtgttggcacaaagtcgaataatgttaccagtattttgtgggatttctggttcatataaaacgatatctaacataattttctctctaattctgatataaacgatagctcactattcccgtcgttttttctttcaataacgtccagttttcaggagtgatgagcggtttatctttctctgtttctacgtaaattaacgcattgggttttagccagttattttcacaaagcaaactaattgcttgttctgccaaattaaaatgaaatggaggatctaaaaataccacatcaaagtgcggttgattttgtggctgttttagaaaatccaaactactttgattaattacttcagcctgttctgatgagcatttgagtgtttgtaaattcttttttaattgattggcgacagttttatctagttctaaaaaagtcacttttttcgcttggcgagaaagtgcttcaaaacctaatgaaccactccccgcaaagccatctaaacattcagattggtggatataaggcattaaccaattaaaaagcgtttctttcactctatcgccagttgggcgtaagccttcagaatttaatacgggaagttttcgccctcgccatagacctgcaataatgcgaacctcgccctttgcatttggcgtttgtatttttttcataaagattcgatttttattgaaaattgtgcttagtttagacgattttttgctagaatgaacgacatttttatcggattacagttaagagagcattttatggctgaagaaaataaaaaaggcggattttgggcatcgttatttgggcgtaataaaaagcaagatgaacctaaaattgagccgataattgaagaagaaaagataaaagatatcgagccgtctattgaaaaatttgaagctaatgatttagtcgaagaagaaaaaatacaggaaatttcaaccgcacttgagccgattgaagaaatcatcgaagcgaaaaatttagaagatgagtttcagcctgttgttgaaattgaaactcgcgaaaaaccaagtgaagggggcttttttagtcgtttagttaagggattactgaaaactaaacaaaatattggcgcgggttttcgtggttttttcttaggaaagaaaattgatgatgagttgtttgaagaattagaagaacaacttttaattgcggatattggtgtgccgacaacaagtaaaatcatcaaaaatttgactgaacacgcaagccgcaaagaattacaagatgccgagcttttatatcaacaattaaaagtagaaatggcggatattcttgagccagtagcacaaccgttagagattgatagcacgaaaaaaccttatgtgattttaatggtgggcgtaaatggcgtgggtaaaacaacgacaattggtaagctcgcacgtaaatttcaggctgaaggaaaatcagtgatgcttgcagcgggcgatactttccgagcggcggctgttgagcagcttcaagtttggggagaacgcaatcatattccagttgttgcgcaaagcacgggttctgattctgcgtctgtgatttttgatgcgatgcaatcagcggctgcacgcaatattgatattcttattgcggatacggcgggtcgtttacaaaataaaaataacttaatggacgaactgaaaaaaattgttcgtgttatgaaaaaatatgatgaaactgcgccacatgaaattatgcttacgctggatgctggcacgggacaaaatgctattagccaagcgaagttatttaatgaggctgtgggtttaacaggaatctctctaactaaattagatggcacggcaaaaggcggcgtgatttttgccatagccgatcagtttaagttgcctattcgctatatcggtgtaggcgagaaaattgaagatttacgtgagtttaatgcgaaagaatttattgaggcattattcgttcatgaagaagaataaaaagaataaggaagaattgtgattaagttctcaaatgtttctaaagcctatcatggcgcaacacagcccgccttacaaggcttgaattttcatcttcctgtgggaagtatgacttacttagttgggcattcaggcgcagggaaaagtacattactcaagcttattatgggaatggaaaaagccaatgcgggtcaaatttggtttaacgggcatgatattactcgcttgtcgaaatatgaaattccatttctgcgtcgccaaattggtatggttcaccaagattatcgtttattaacagatcgtactgtagtggaaaatgtggcattgccgttgattattgcaggtatgcatccaaaagatgcgaatactcgagcaatggcatctttagatcgtgtaggattgcgtaataaagcccactatttgccaccgcaaatttctggcggagaacagcaacgcgttgatattgcgcgtgcgattgtgcataaacctcaactcttattggcagatgaaccaacgggtaatttagacgatgaactttctttagggatttttaatttgtttgaagaatttaatcgtctcggaatgactgtgttaattgctactcacgacattaatttaattcaacaaaaaccaaaaccttgtcttgtgcttgaacaaggttatttacgttattaaggaataatcatgagccgatcaacggatgcatctgtttttgttcaaacagcctatactttgcgtgcagtatgggcggatttgtggcaacgtaaatttggcacgctgctcacgattttagtgattgccgtttcgcttacgatcccgactgtgagctatttaatgtggaaaaatttgcatttagccaccactcaattttatcctgaaagtgaattgactatttatcttcataaaaatttaagtgaggaaaacgcaaatttagtggtagagaaaatccgtcagcaaaaaggcgtggaatcactgaattatgtctctcgtcaagaaagtttaaaagaattcaaaagttggtctggctttggtgaagaattggaaattttagatgataatccattgcctgcggtcgttatagtaaaaccgacgagcgaatttaatgtttcagaaaaacgtgacgaattacgaaccaatttaaataaaattaaaggcgtgcaagaagttcgcttagataacgattggatggaaaaattgaccgcactttcttggttaatcgcccatgtggcaattttctgcactgtattaatgacgatagcggtatttttagttattggtaacagtattcgctctgatgtgtatagtagccgatcaagtattgatgtgatgaaattgcttggtgcaacagatcaatttatccttcgtccttatctttatacagggatgatttatgccctgttaggtgggttagttgcagcaatttttagtagctttattatcagctattttacttctgcggtgaaatatgtaacggatatttttgccgtccaattcagtttgaatggattaggcgttggcgaatttgtattcttattagtgtgctgtttaattatgggctatgttggggcgtggattgccgcgacaaggcatattgcgatgatggagaggaaagaataattggatatcaaaagaaaagcgaatttcttaaaagaaattcgcttttttagttagaagtgaaatatttcgctgttgtagtttaggaagtaaatagttataagcgttctacaatcatagaaatcccttgaccaccgccaatacaaagtgtagcaagtccaagttttttatctttttcgataagattgtgcaataacgttactaaaatccttgcaccactcgcgccgattggatgcccaagtgcgatcgctccaccatgaatattggttttattcatatccaaattgagatctttgccaacacctaagaactgtgaggcaaaggcttcatttgcttctatcagatcgatatcatcaagatttattcctgcttttttcaatgctttttgcgttgctggaactggacctaatcccataacagatggatctaccccaccgctggcatagcttctaatttttgcaatggcttttaatccaagtgcatgagctttgctttcgctaactaaaataagtgctgcagcaccatcattaatgccagaagcgttacctgcggtgacagtaccctcttttttgaaagcaggttttaatttagctaaaccttcagctgtagtatctgctttaggatactcgtctcgtgaaacaataatgtcacctttgcgagtttttaccataacagggacaatttccttatcaaatacacctaattgcacggcttgagatgctaaggtttgtgaacgtaatgcgagttcatcttgtgcttggcggctaataccatattgttctgcaatattttcggcagtaatccccatatgatagtgattgctagcgcaagttagtccgtcttcaatcattgtgtcccttaatgtgagattacccattttgacgccttgtcgtactttgctatctaaaagataaggtgcttggctcatattttccatgccacccacaacaacaatatcagcatcaccactgataatagactgtgcacctaatgcgacactttttagaccagatccacatactttattgattgttaaagaagggatttctttctctattcctgcttttaatgctgcttgacgggctggattttgccctagtcctgcttgtaatacgttccccatgatgacttcattaactaatgcactttcaatgttggcacgtttgatggcttcttgtatcacaattgcacctaaatcaaccgcacttacggaagataatgcaccattaaagctgccgatcggtgttctaactgcactaacaataacaacattttccatttttaactccttttctataagaaatataaaccaataataaaaattggtgcggtgaagataagtgcggtcatacagaagcccataatatctctcacgccaagccctgcgatacccagtgctggtaatgcccaaaatggctgagccatgttcatccattgctcaccataggcaatcgccattgtagacttacctagatctgcacctaatgcttgagcagcagggataacaaatggtccttggatgacccagtgaccgccaccagaaggaactgcaaagttaataaaggcagaactaaagaaggttaataatgggaaagaatctttgttagcaacattgataaagaattcggtgattaaaccacctaagcctgaatgctccatcattagttgcacacccgcatagaatgggaattgcactaagatccctgctgtgcttcgtgtggcattaataattgctcgcatataggccattggcgagccatgaagcacaattcctgtgattaagaaaataaggtttacattattaattgtgagattgaatccgtttttgtagaaatacataccgaggtaactatatcctaatgccccgattgtataggctaagaagcggctttcttccattttttcagcaagtgttgcatctttatccaattttttatcaaatgttggatcgggcgcaataagttttggatcaatactttttgtttcgccatttttgggcatcatcatataggtaatgaaaggcaagcaaatgactaaacttaacgtgataaaaatattgtacccagagaaaagcgtactaactgcaggaataataccttgtgggttgctttcgctcatcattaaatgagcaactgggttgcctggtgttgcggctaaaagtggcattgagcctgaaaaacctccaccccatgtcataaatgcaatataggcacaggcaatcagtaaggcgtagtcactgccttttattctccgcgcgacttcttttgcaaacatcgcaccaacgaccaaaccgaagccccagttaatgatacaggcaattgaacccataaacgtaactaagacaacaccttgtgctggtgtttttgcgattgaagcgattgtagaaagaaacttacgaatttgtggtgaggttgcaagagcattaccagttacgacaattaatgccatttgcataccaaaaccaagtaaattccaaaagccattaccccacatattaactaaatcaacaggtgtactatcggttaatccccaagcacaaatgaatgtgacaaaggtgagtaacacggcaaaaataagtgggtctggcaggtatttactgacgaatgtcgtcataaaacgagaaacgcgactaatcataattcaagtcctttctggctgatttgcatttctttgaaatcatcggcaacaatgaaatcggcttctgttttggctttaattgtttctaaatccacatgaggagcatgttcttttagaactaatctgccttcaatgaagttaaatactgccaattcggtaaccaccatggcaacttttttacttgctgtgagcggtaatgtacatttctttagaatttttgaggaacctgacttggcacaatgttccatgccaataatcactttttttgcaccagtcactaagtccattgctccgcccattcctggtaccattttgccaggcaccatccagttagcgagatttgcttcttgatcaacttcaagtccacctagcacacaggcatcaacatgaccgccacgaattaaagcgaaagaaaaagcactatcaaaagtagagccgccttttttaattccacaaggctgaccaccagcatttactaagtttgaattagcattttctgggtcaaatgcagttaaaccaagaaagccattttctgattgaagtgtaatattgacattatcaggtaaataattaacaacctgtgttggtaaaccaataccgagattaacaatatctccatcatgtaattccatcgcaattcggcgagcgattaattcttttgcattcatggcgttctccttattctgaacaaacaatgtaatcaattaatgcggctggcgtgatgacttcatctgggggtaactgaccgacctctagtagattatcaacttgggcaatgacagttttggctgctaaagcaactagtggattaaagttcctagcagataattcataagctaaattgccattcatgtcacctttttgagcatggataatggcaatatcagcttttagtgggagttcaagcaaatattctctgccatcaatttgaattttttgttttccttcttcaacaacagtgccgacacccgttggtgttaaaataccacctaatccggcgccacctgcacgaatccgttcagctaaggttccctgtggaacgagttctacatctatttcaccagcaatcatttttttgccagtttctggatttgtaccaatatgggaggtaattaaacgtttgactcgattatttacaattaaagggcctacgccagtgtcaataaaggctgtgtcattgcctatgagtgtgagatcctttacgccagaatctaagatttgttggacaagtttggctggagtgccgatacccataaatccaccaaacatgatgctcataccatcatgtaggtgttgatttagattattaagcttaagatgtttttgtgtcatagagacctcctaataacgagattaaaagaaagaatatcaacaaataagtatcttatatttcaaatggatatgtttcttgcgatgatccttgataggcaataaaggaactagattgatattaaaaatagcaaaaagaatttcgtaaaagaaatacatctttcttaggcgggtataagttattttgatagtgttttaaacaatccttgtgctatattttgtaaaaatggcagtccttaggggggtgaaaatgatggatattaggcatctaagatattttgtttcaatcgtagataatgattttaatttaagccgagcgtctcaaaatttatatgtgtctcaacctgcattaagtatgatgattacggagtttgagaatcgtgaaaatattcagatatttaaacgggcatcaggaaaaattattggactaacctttgcgggggaaaattattatcgtgatgcaaaagaagtgatcaagcgttacaatgatatgagaacaaatctttataaatcaaaagattgtaagaaaggcacgataacaattggtattcctcccttagttttatcagccgtgttctcttctgtattgcctcatcttattcttaagaatccagatattaatttcattattaaagaaattggagcttatgctctaaagagtgaacttcttttagataaagttgatttagccgtgttgttatatcccgagcgaatatcaaaaaatattattgattcaattgaaattcatagttctgaattagccttatttctttcaccaaagcatgttttagcaaaaaaacaacaaatcacatgggctgatttacatcagcagaaaatggcaatttttgatcaaacatttatgattcatcatcatttgaaggaagcttttgagcgcaataattgttatccagatattgttttggattcgagttgttgggattttctgctaagtgcggtcaaaacaaacaaagaattattaactattctaccgttacctatggctgagctttatcattcaaaagaatttttgtgtcgtaaaatcgaaagtcctgttccgtggaaagtgacactatgtcgtcaaagaaaaacggtctacacacatcttgaagaatatatttttgataaattattagaggcttttagaccaacaaaatagttaaaataaaagcttgcaaatagggttgtctttctatagaatctacgagctctcaatatgagagccgtttaatgtaatcatttattgaacgggcatgacgatatgtcaggctaacaatgtttccgatttggagactatataacaggtaacttgcacctccttttctattttgaagttagaattgcgattggtgttagtttttttattagctaaattttattggagctctggtctaatgcagaaccaaagaatccgtatccgcttaaaagctttcgatcaccgtttgatcgatcaatctactgcggagatcgtagaaacagctaaacgtactggcgcacaagttcgtggtccaattcctttaccaactcgtaaagagcgtttcaccgtgttgatttctccacacgtaaacaaagacgcacgtgaccaatacgaaattcgtactcacaaacgtttagtagatatcgtagagccaacagaaaaaactgttgatgcattaatgcgtttagatttggctgccggcgtggacgtgcagatcagcctaggttaattaagaggttattacaatgattggtttagtcggtcgtaaagttggtatgacccgtatcttcaatgaagacggcgtgtcagtaccagttaccgttatcgaaattgaagccaaccgcgtaactcaagttaaaactcttgaaaacgatggctatactgcagttcaagttactactggttctaaaaaagcgaatcgtgtaactaaacctgaagcaggtcatttcgtgaaagcaggtgttgaagctggtcgcggtttatgggaatttcgtactgaaggtgaagaattcactttaggtcaagaaatcaatgtagacatctttgcagatgttaaaaaagtagatgttactggtacttctaaaggtaaaggtttccaaggtggtgttaaacgttggaacttccgtactcaagatgctacacacggtaactctttatcacatcgtgtacttggttctattggtcaaaaccaaacaccaggtcgtgtgtttaaaggtaaaaaaatggcaggacatttaggtgctgaacgtgtaactgttcaatcacttgaagttgttcgtgtagatgctgagcgtaaattgctattagtaaaaggttctgtacctggtgctatcaatggcgatgttatcgttaagccggcagttaaagcataagtctaggagatagagatggaattacaagttgtaggtgcaaacgcactcactgtttctgaaactaccttcggacgtgagtttaacgaagcgttgatccaccaagttgttgttgcttatgcagcaggtgcgcgtcaaggtactcgtgcacaaaaaactcgtgctgaagtgtctggttcaggtaaaaaaccttggcgtcaaaaaggtacaggtcgtgctcgtgctggtgatatcaaatcaccaatctggcgttctggtggtacaaccttcgcggctaaaccacaagatcacagccaaaaagtgaacaagaaaatgtaccgtggtgctatcaaaagcattctttctgaattagttcgtcaagaccgtttggttgtggtggaaaaatttgaattagatgcaccaaagactaaagttttagtacaaaaattaaaagatttagccgttgaagatgcgttaattatcacagcaagtttagatgaaaatctattcttagcagcacgtaacttatataaagttgatgtccgtgatgttcaaggtatcgatccagttagcttgatcgctttcgataaggtgattgttactgttgatgctgtgaaacaaattgaggagatcctagcatgagtcaagaacgtttgctaagtgtgctacgtgcaccgcacatctctgaaaaagcaactaacaatgctgaaaaatctaacactgttgtacttaaagttgctttagatgcgaacaaagctgaaattgctgctgcggttgctcaattatttgaagtaaaagtagattcagttcgtactgtggttgttaaaggtaaaactaaacgccgtggtaacaaaatgggtcgtcgcagcgactggaaaaaagcttatgtaactttagccgaaggccaaaacttggacttcgtggacagtgcagagtaatcggaggaaattagagaatggctatcgttaaatgtaagccgacctccgctggtcgtcgtcacgttgttaaaatcgtgaaccctgaattacacaagggtaaaccttacgcacctcttctagatactaaatctaaaactggtggtcgtaacaactatggtcgtattactactcgtcacattggtggcggtcacaaacaacactaccgtttaatagatttcaaacgtaacaagttagacattccagcggttgttgagcgtttagaatatgatccaaaccgttctgctaacattgctttagtgctttataaagacggtgaacgccgttatattttagcacctaaaggtttgtcagtaggcgatcaaatccaagctggcataaactcaccaattaaagtgggtaactcattaccaatgcgtaatatcccagttggttcaacagtacataacgttgaattaaaaccaggtaaaggcggtcaaatcgctcgttctgctggtgcttatgtacaaatcatcgcacgtgaaggcaactatgtaactttacgtttacgttctggtgaaatgcgtaaagtattagctgaatgtgttgctacaatcggtgaagttggtaactcagaacatatgcttcgcgtattgggtaaagctggtgctaaccgctggagaggtattcgccctacagttcgtggtactgcaatgaacccagtagatcacccacacggtggtggtgaaggtcgtaactttggtaaacacccagtaactccttggggcgttcaaactaaaggtaagaaaactcgtcacaacaaacgtactgataaatatatcgtacgtcgtcgtggcaaataatagattaaattaaagaggattagccatgccacgttctctcaagaagggtcctttccttgacctacacttgttgaagaaggtagagaaggcggtggaaagcggggataaaaaaccaattaaaacttggtcccgtcgttcaatgatcattccatcaatgatcggattgaccatcgcagtccataatggtcgtcagcacgttcctgtttatgtatctgatgaaatgatcggtcataagcttggtgaatttgcaccgactcgtacataccgcggtcacgcggcagataagaaagctaagaaataagaggtaaagagatggaaactatcgcaaaacatcgttacgctcgcacttctgcccaaaaagctcgcttagttgccgatttaattcgtggtaaaaaagttgcgcaagcattagaaattttaactttcactaacaaaaaagcagcagctttagtgaagaaagttttagaatcagctattgcaaatgcagagcacaatgacggtgcagatattgatgatcttaaagttgctaaaatcttcgttgatgaaggtcctagcatgaaacgtgttatgccacgtgctaaaggtcgtgcagatcgtattttaaaacgtactagccacattactgtggttgtgtcagatcgttaataagtagaggaatagcaatgggtcaaaaagtacatccacatggtattcgcctaggtattgttaaaccttggagctctacttggttcgcgaatacacaagacttcgctgacaatcttgaaggcgatttcaaagtacgcaaattcttaaataaagaattagcaagtgcttcagtttcacgtattactattgagcgtccagctaaaagtattcgtgtaactattcacacagctcgtcctggtatcgtaatcggtaaaaaaggcgaagatgttgaaaaattacgtaacgcagtgtctaaaatcgctggcgttcctgctcaaatcaacattgctgaagtgaaaaaacctgaattagatgcgaaattagttgcagatagcatcgcttctcaattagaacgtcgtgtaatgttccgtcgtgcaatgaaacgtgcggtacaaagtgctatgcgtttaggtgctaaaggtatcaaagttgaggttagcggtcgtttaggtggtgcagaaatcgcacgttcagaatggtatcgtgaaggtcgcgtacctctacatactcttcgtgcggacatcgattataacactgcagaagctcacacaacttacggcgtaatcggcgttaaagtgtggatcttcaaaggtgaaattcttggtggaatggctgccgttgcgcaatcagaacaacaacctgccgacaagcctaaaaaggctcctcgcggtaaaggtcgtaagtaaggagaaacgctaaatgttgcaaccaaaacgtacaaaattccgtaaagttcacaaaggccgcaaccgtggtatcgcgagcggtactgaagttagtttcggtacttacggtttaaaagcagttggtcgttgtcgtttaaccgctcgtcaaatcgaagcggcacgtcgtgcaatgtcacgtgcagtaaaacgtcaaggtaaaatctggattcgtgtattcccagataaaccaattactgaaaaaccattagaagtccgtatgggtaaaggtaaaggtaacgttgagtactgggtagccttaatccaaccgggtaaagtgctttatgaaatggatggtgtgtctgaagaagtagcaagaaacgcatttgcattagcagctgctaaattgccagttaagaccactttcgtaactaagacggtgatgtaatgaaagctcaagatttacgtacaaaaagtgttgaagagctgaatgctgaattagtaaaccttttaggtgaacaattcaagttgcgtatgcagacagccaccggtcagcttcaacaaacccatcaggctaagcaagtgcgtcgtgatattgcacgtgtaaaaactgtattaaccgaaaaggcgggtgagtaatgactgataaaattcgtagcgtacaaggtaaagttgttagcgacaaaatggaaaaatctttcgttgttgctattgaacgtaaggtaaaacaccctttatatggtaaatttatccgtcgtacaactaaattacacgtacacgatgagaacaatgaagccaaagttggtgataccgtagagattcgcgaatgtcgccctctatcaaaaaccaaatcttggactttagttcgtgttgttgagaaagcagttattgcttaattaataacaaagagtaataaaataaaagccaatagtgtaaatctattggcttttttgtttttaaagtgcggttaaaattcaatgaattttaacccgcaccttttcttttaggtgttattgacataacacctaaacaaatactgaaaaaaatatttttaataatggtacttaagagaaatttctgaagatcttggttttgaatattctgatgagtggaatactcgttatttgggtcatagattaattaatttcatcaacggcgttgatacccgtaaagaaacgtcaaaattagcagaggataaattcccagaagaacttatcaatgatacagatactactgggaatatttctaatgaagattgggattggtggtgccatttatctgatacaatgaagtatatattgatacatgatcttccttatcaagaagaggagattggcatcacagagttttatgatgaaaatgatttggatacagaagcagatatatatgatcgagagacttttggaatcttattaggagaatatgtaacaggattatatttgttagatgatacttttatagagccagtgcttgataatataaatattcctaacaatgtttatagtacaaatatatttgctattcattatgttgcaaagcatattttgggtattaaagatctagataaacgtttaaaatctggtgatattgaattagttcgtgaattaggagaagtaacaattggtggtaaggagaagtatttttactcttttgcaactaaatattgtagtcatcataatccaattgctttcccaatttatgatagctatgtggagcaagttctcctctattttaataaagtagataaattttcagcctttaaaaggaaagatttaaaaaattacagaaaatttaaagaggttttgatagattttcaaagatttaacttaaaagaactcgatctgtatctttggcttttaggcaaggaaattttcccaaaatctaaaaactgatgaatttatctaaggtaagagaagagagcatttcattttttctgcagtttatttttcattcgataaatttttgagaggatgaggatatttttataattccaaaagtgcggtaaattttaactggattatttagtaaatagatcaataagaggaagctaaattatcattgcctttctctttttcttttgataaaatccgccgcctatctgccattctatctgaatagtgtggatgggttcgtcccgaaagggtgtttttttaatcttaacggagcactaatatgatccaagaacagactatgctggatgttgctgataattcaggcgctcgcagcgtaatgtgtatcaaggttctaggtggatcgcaccgtcgttatgctgcgattggcgacatcatcaaaattactgtaaaagaagcaattccacgcggtaaagtaaaaaaaggtgatgtattaaaagcagttgttgtgcgcaccaagaagggtgttcgtcgcccagatggctcagttattcgtttcgatggtaacgcttgtgtaattttaaataataacactgagcaaccaatcggtactcgtatttttggaccagtgactcgtgaacttcgttctgagaaattcatgaagatcatttctttagctccagaagtactgtaaggggaatgtaatgcctgctaaaatccgtcaaaatgatgaagtaattgtccttactggtaaagataagggcaagcgtggcaaggtaactaaagtgttaccaaacggtaaagtgtttgttgaaggtatcaacatcattactaaacatgaaaaaccagttcctgcattaggaaaggctggtggtttggtgaaaaaagaagctgcaattgacgcttcaaatgttgcgattttcaatcctaaaacaaataaagctgaccgtgtaggttttagattcgaagacggcaaaaaagtacgtttcttcaaatctaacaatgaaattatctaacaaactggagtaatgcgatggcgaaactgcatgattactacagagatcaagtagtaagcgaattaaaaaataaattcggctacaaatctgtcatgcaagtcccacgaatcgaaaagattaccctgaatatgggtgtgggtgaagcattgaccgacaaaaaattgctagacaacgcagtagcggacttagcagcaatcagcggtcaaaaacctttagtaactaaagctcgtaaatctgttgctggctttaaaatccgtcagggatatccaatcggttgtaaagtaacactacgcggtgagcgtatgtgggagttctttgaacgtttaattacaattgctgttccacgtattcgtgacttccgcggtttaagtgcgaaatcattcgatggtcgtggtaactatagcatgggtgtgcgtgaacaaatcatcttccctgaaattgattacgataaagtagatcgtgtacgtggtttagatatcactatcacaactactgctaagaatgatgaagaaggtcaagcactacttgctgcctttaatttcccattccgtaaataaggcaggttataatggctaaacaatcaatgaaagcacgcgatgtaaaacgcgttaaattggctgaaaaattctacgcaaaacgtgttgaattaaagaaaatcatttctgatgtcaatgcctctgatgaagatcgttgggatgcagtgttaaagttacaaactttaccacgtgattctagcccatctcgtcaacgtaaccgttgccgccaaactggacgtcctcatggcgttttacgtaagtttggtttaagccgaattaaggttcgtgaagctgcaatgcgcggtgaaatcccaggccttaaaaaagcgagctggtaatataccactttattttggaatcggagaaaaagtacaatgagtatgcaagatccaatcgcagatatgctgacccgtattcgtaacggtcaagctgcgaacaaagttgcaatcaatatgccttcttccaagctaaaagtggcaattgccaacgtattagctgctgaaggttatatcgaaagcgtaaaagttttagaaggtgctaaacctgaattggaaattactttaaaatatttccaaggcaaaccagttgtagaaagcatccaacgtgtaagtcgtcctggtcttcgtatttacaaacgtaaagatgaattaccaaaagttatgggcggtttaggtgttgcagttatttctacatctaaaggtgttatgactgaccgcgctgctcgtcaagcaggtttaggcggtgagatcatctgttatgtagcttaatagagaggtaggaaaatgtctcgtgttgcaaaggcacctgttaatattcctgccggcgttgaagttaaactcgacggtcagctattaacagtaaaaggtaaaaatggcgagttatctcgcaaaattcatgaatcagttgaagtaaaacaagataacggacaatttacgttcactccacgtgaaggttttgttgaagcaaatgctcaatcgggtactgcacgtgcattagttaatgcaatggttatcggtgttactgaaggtttcactaaaaaattagtattggtgggtgtaggttacagagctcaacttaaaggtaacgcaattgcattaagtttaggctattctcacccagtagagcacactttgccggtaggtattactgcagaatgtccatctcaaaccgaaatcgtgttgaaaggtgcagacaaacagttgatcggtcaagttgcagcagatattcgtgcttatcgccgtcctgaaccttataaaggtaaaggggtacgttacgctgatgaagtggtacgtatcaaagaggctaagaagaaataattaaggtaacactatggataagaaatcagctcgtatccgtcgtgcagctcgtgcacgtcatatgatgagagagcaaggtgtaactcgtttagttattcaccgcactccacgtcatatttatgcacaagttattgcaccaaacggttcagaagtgcttgccgctgcttcaactgttgagaaagcaattcgtgagcaagtaaaatacaccggtaataaagatgctgctgcagcagtaggtaaagctgttgcagaacgcgcattagcaaaaggcgttcaagctgttgcttttgatcgttccggttttaaatatcatggacgtgtccaaactttagcggacgctgcacgtgaagctggtctacagttctaatgaggtaaattgagatgtcaaacatcgaaaaacaagttggtgaactgcaagagaagctaatcgcagtaaaccgtgtatcaaaaactgtaaaaggtggtcgtattatgagtttcactgcattaacagtggtgggcgatggtaatggccgagtaggttttggttatggtaaagctcgcgaagttccagcagcgatccaaaaagcgatggaaaaagcacgtcgcaatatgattaatgtcgctttaaatgaaggtacattacaacatccagttaaaggtgttcatactggttcacgtgtatttatgcagccagcaagtgaaggtacaggtatcatcgctggtggtgcaatgcgtgcggtattggaagttgcaggtgtacgtaacgttctttctaaagcgtatggttctaccaacccaattaacgttgttcgtgcaactattgatgcattagcaaatatgaaatcaccagaaatggttgctgcaaaacgcggtaaaactgttgatgaaatcttggggtaatgaataatggctaaaactattaaagtaacacaagttcgtagctcaattgctcgtttaccgaagcataaagctaccttgcgtggtcttggtcttcgccatatacaccacactgttgagttaattgatacgcctgcagtacgtggtatgattaaccaagtttcatacatggttaaagtggaggagtaagagatgcgtttaaatactctatctccggctgaaggtgcaaagcatagtgctaaacgcctcggtcgtggtattggttcaggtttaggcaagactggtggccgcggtcataaaggtcaaaaatctcgtactggtggcggtgttcgtcgcggtttcgaaggtggtcaaatgccgttataccgtcgtttaccaaaatttggttttacttcaatgaaatctgcagtgactgcagaagttcgtttaaatgaattaaccaaagttgaaggtaatgtagtaactttagaaacattaaaagcagcaaatatcttaactaaagatatccaattcgctaaagtaattttagctggagaagtgaaatctgcagtaacggtacgcggtttacgtgtaactaaaggtgcaaaagcagcaattgaagctgctggcggttcaattgaggaataattagcaaatggctaaacaaccaggttatcaagcaagaagtactaatagcggtaaaggtgaattaaaaagccgattacttttcgttttaggtgcacttatcgtttatcgaattggttcattcattccggttcctggtattgatgcggctgttctagctcaattagttgaacaacaaaaaggcactatcattgacatgtttaacatgttctctggtggtgctctaagccgtgcatccattttagcattaggaatcatgccatatatatcggcatctattgtaattcaattgcttgcaacggtttctcctgctttagcagaattaaagaaagaaggtgctgctggtcagcgtaaaatttctaaatatactcgttatgcgacagttgtttttgcaacgattcaggcagtagctatttcaacaggcttaccaaatatgttgtctggcttagtgccaaatgttggatttagtttttacttcacttcagttgttagtttagtcactgggacaatgttccttatgtggttgggtgagcaaataactgaaagaggtattggtaacggtatttcaattcttgtttttggcggtattgtagctggtttaccatcggctattcttcaaactattgagcaggctcgtcaaggacagatgcatccatkagttcttcttctgatcgcagctattgtatttgcagtaacttattttgttgtttttgttgaaagaggacaacgtagaattcgcgttgaatatgcgaagcgtcagcaaggtcgtcaaattttaggtggtcattcaacacatttaccattgaaagtgaatatggcaaatgtaatgccagcaatttttgcttcaagtattattttattcccagctacattaacacaatggtttgggcaaaatgataaatttgaatggttaaataatttatcaatgttattgaatcctggtcaaccactttatttgcttgtttatgctgttgcaattattttcttcagctttttctatacagcaatgcaatataatcctcgtgatacagcagataatctaaaaaaatctggtgcatttattccaggaattagacccggtgaacaaacatcacgttatattgataaagtgatgactcgtcttacattaattggcggtctctatgtaacgtttgtatgtttagttccttatattatgacatcggcttgggatgttaaattttacttcggtggaacatctcttttaattgtagtcgttgtaattatggatttcatcgttcaggttcaaagtcatttaatgtcttctcaatatgaatctgcgttgaaaaaagcaaaccttaaaggttttggacaataattgttcatttaaagtaaaaggataagcaatgaaagttcgtgcttccgtaaagaaaatgtgtcgtaactgtaagattgttaaacgtgagggtgttgtacgcgtattgtgtagcgaccctaaacacaaacaacgtcaaggttaattaacatttttcttgccaagaaccngttgagtagttatactgctcaactcatttatgtccttgatattctgtttgagtatcctgaaaacgggcttttcaagatcagaatatcaaattaattaaaatataggagtgcatagtggcccgtattgcaggcattaacattcctgatcataaacacgctgtaatcgctttaactgccatttacggtattggtaaaactcgttcacaagctatttgtgcagcagcgggtattgctgaagatgttaagatcagagaattgtctgaagagcagattgacaaactgcgtgacgaagttggtaaatttaccgttgaaggtgacttacgtcgtgaagtaacactaaacatcaaacgtcttttagacttaggatgctatcgtggtttacgtcatcgtcgtagtttaccagtacgtggtcaacgtactaaaactaatgcgcgtacccgtaaggtccacgtaagccgatcaaaaaatagtcggggtaaataagaatggctaaaacaccagttcgtgcacgtaaacgtgtaaaaaaacaagttgtagatggcgtacgacatattcacgcatctttcaataatacaatcgttactattactgaccgtcaaggtaatgctctagcttgggcaactgcaggtggttcaggtttccgtggttctcgtaaatcaactccgttcgcagcgcaagttgcggcagagcgttgtgctgaaatcgttaaagaatttggcttaaagaacttggaagttatggttaaaggtccgggtccaggtcgtgaatctacaattcgtgcgttaaacgcagcgggtttccgtatcacgaatattactgatgtgactccgattcctcataacggttgtcgtccaccgaaaaaacgtcgtgtttaagacgtataggatagttggagaaagaaaatggcaagatatttgggtcctaaactcaagctcagccgtcgtgaaggcactgatttattccttaaatcaggcgtgcgtgcgattgattcaaaatgtaaaattgatacagcaccaggtcagcacggtgctcgtaaaccgcgtttgtctgactatggtagtcagttacgtgaaaaacaaaaagttcgtcgtatctatggtattttagaacgtcaattccgtaactactataaagaagcaaaccgtttgaaaggtaacactggtgaaaatttattagtgttattagaaggtagattggataacgttgtttatcgcatgggatttgctacaactcgcgcagaggctcgtcaattagtgagtcataaagcaattgttgtgaatggtcgtgttgttaatattccatctttccaagtttctgtaaatgatgtagttgctattcgtgaaaaatcgaaaaaacaagctcgtattaaagcatcattagaattagcagagcaaagagaaaaaccaacatggttagaagttgattctgcaaaaatggaaggtgtattcaaacgtgttcctgaacgttctgatttatcagcagacattaacgaacatctgatcgttgagctttactctaaataatagttaagcttaaaaccaaagagaggataaaatgcagggttctgttacagaatttttaaaaccacgtttagtagatattgaacaaattagttcaacacatgctaaagtgatcttagaaccgttagagcgtggttttggtcatactctaggtaatgcattgcgtcgtatccttctgtcttcaatgccaggttgtgctgtaactgaagtagaaattgatggcgtattgcatgaatatagtagtaaggaaggtgttcaagaagatattcttgaagtacttttgaaccttaaaggtctagcggttaaagtacagaataaagatgacgttattctgacattaaataaatctggaattggccctgttgttgcagcggacattacctatgatggtgatgttgaaattgtaaatccagatcatgtgatttgtcatttaactgatgaaaacgcttcaattagtatgcgtatacgtgttcagcgtggtagaggatatgttcctgcttcatctcgtacacatacgcaagaagaacgtccaattggtcgtttgcttgttgatgcttgttatagtccggttgaacgaattgcgtataatgtagaggcagctcgtgttgagcagcgtacagatttggataagctcgttattgagttagaaactaatggtgcacttgagccagaagaagcaattcgtcgtgcagcaacaatcttggcggagcaacttgatgcattcgttgatttacgtgatgttcgtcagcctgagattaaggaagaaaaaccggaatttgawccgattttattacgtcctgtagatgatttagagctgacagttcgttctgctaactgtttgaaagcagaaacaattcattatatcggtgatttagtgcaacgtactgaagtagaattattaaaaacccctaatcttggtaagaaatctcttactgaaattaaggatgttcttgcttctcgtggcttgtcacttggtatgcgccttgaaaattggccgccagcaagtattgctgaagactagtttggtcataggttaagattttyctgagaaggataagatcatgcgccatcgtaagagtggtcgtcaactaaaccgtaatagtagtcatcgtcaagcgatgttccgtaacttagcaagtgctttagttagtcatgaaatcattaagactactttgcctaaagctaaagaattacgccgtgtagttgaaccgttaattacattagcaaaagtagatagcgttgctaaccgtcgtttagcattcgctcgtactcgcaacgttgaaactgttgcaaaattatttaatgaattaggtccacgttttgctcaacgtgcaggtggttacactcgcattttgaaatgtggttttcgtgcaggcgataatgcaccaatggcatacattgagttagttgatcgtccagaagttgctgaggcaacaactgaggaataaaaattaattctaaaaagaagctcactttatatagtgggcttttttattttatatattaaaaaaatctttatctgatttaatcattacttagatatattatttacaatcagcgagcagtggtaaattttaagagcatattcgtagatgtcgtgtatttttatctaaattccttgttttttaagctctctactaatacgaattgcggtttcagtttcacatccacaaaattccgctgcttctcggtaggcccaaggataatcgggataactttcagttaaattttcaatggcatcaataatacgttcgtaactacgcttataagctgtattacttattcggtgttctgcatcaataattcattagaaagttgtttcataagataacaagaaaaatcagggttatttgcaataaaatttgcgtgattaccaggaaatattctaactatatcggcttccattaatacttttgcactgcaatgataagatgtttcactaaaaatagtacgaaaaccaaaatattcattagcgtgataaagtcgagtcaatgtttctttgccattttccagactatgatacagaccaactagcccttgttttaaaaaataaaattctttaggcttctcgccttgtgcataaattaagctgtttttttctagagttttactctcagaaataatacatttatttaagttttgtggtagataatagggcaatgtaaacataaaggcgtcttttaatatataaataactttagattactatacaaatttctatattttyctgctataagcaaattatgaaaatgtgaagtgtttaacaaaattttgaactagataaatattattttattttgccaaatgattttgcaaatgactttaaatatggttccatatgagaaagtgctgaataatatgcctcacaaagttgattatgtgctttaccaaatccttgaattgtacgatgttttggacatcctccgtgacatgcaaagcgaaacttacagattttacactgttcggaaagaaaagatttcgctgcaccaaaattcttttgtttagtattattatcaaggagctgtattagaggggtttcaataagatttccgagtttatattcaggataaacataatgatcgcaactataaatatcgccattttgttcaataaccaattgatcgccgcaggtttcacgaaaaatacataaacttggttgtaaaccaaggtaagccataaaccattgttcaataaattgaataccaattttgccgatatcattggtataccattcatcaaaaatattaattaaaaattgaccgctcttttgtagaaatcaagacctgctagggttggctcgccgccttgccataggaaagtaacttgttgttgaggcgttgtttcaatataggatttgatataggcttctaatacttcattagtcatagcccgttggtttaagtgaggtttttccaagtaaaagcaatattgacaatctaaattacaaattgaaccagtaggttttgccattaattgaaatgaattcatatctatgtatcctccttattctttttatcatagcagaataattttaactgtatatgatagcgatcataagttgcgcatatgctcttacgtcaaaatgaagtatgattaaatgaatttttaaataggatctaagatggcgtttagtacaatttttatcttactgatttgcggtatttgtaccaatatggtttctgctatttttggtattggcggtggggtattgatggtgccaattttacgtacgttatttcccgaattgccgattcaagttatttcagctacgtcactcaccattgtgatgtgtaccgcattgattaatttattatttttccataagcaaaaaattaaaattgattatatcaatatgattttatggtctattgctatggtgattggggtgcaaattggttttgaattaagtttttatttttctacagcgataattagtttaatttttacggttagtttaagtgcactagcgattaaaacatttttaaacagatcgagaatacaaatagaagtgtttaatatgtctcctatagaacgagctaaaggtagtattagtttttgtggaggaggcttaattgcgggtattacaggtattggaggcggttctattcttgcgccccttgtcgggcaattaaagggggtaaaaacgcaacaaattgccgtttatacgaactatatgatgattattggtggtattggtaatttatatggctatctcacaagagcttttctttatgatgccagtctaagtggccaactaggattaaactttcttgtagttggtgtcgttaccttgggttcatttgaaatgagtttcttctcaatgaaattgcgtggattaatgaatccagttttaacaagaaaattattggcgattattttattttgtattgcagcctatatgtgcattttggaatttgtattccattaaatcgaataaactagacctagttattctaggtctattctctaagtagtgttttcgcaatctctcttgcttgtgcatcaatttcgagtacatcatcaatattttgaatggtataaggcgaaattctctcaattgttttcgaattaatttttgcaatatccataaagccaatttgacgatctaaaaatgcttgtacggcaatttcattagctgcattcattgctgttgtcgcatattgacccgcagcaaaggcatcaatagccagttttaaatttggatagcgattaaaatcaggttcaataaatgtcagttctttgattttaaagaaatcgagtggttctactccagcaaaagtgcggtgaggatatgccatagtttctgcaattggtgtacgcatatctggatttcccatttgagtaatgactgagccgtcaacataccgtaccatagaatgaataattgattgtggatgaataataacttccatttcttccgcacttgcattgaaaagccagcgagcctcaatgtattccaagcccttattcatcattgtagctgaatcgacagaaatttttttacccatagaccaattagggtgtgcaaccgcttgttctggtgttatgttggtgaattgttcaagtggcgtgtaacggaatggtccgccagaaccagtgagtataattttacttacacctaattcagaaagtgggcaaaaaccgattttttcttgtgcttctggcggtaatgattgaaagatagcattatgttcactatctactggtaaaagcttcgagccatagttttttacggcatcaataaaaagctgtccgcaggttaccagtgattctttatttgccagtaatacccgtttacctgctttaaccgctgaaagagtcggtaacaatcctgctgcaccaacaatcgacgccattatctgatcggcatctgggtgtgctgcgagttcgcaaatagctcgtcgtcctgctaatacttccgttggaatatgatgcgcaattaatttttcacgtaaaattttagccgcatttacatcatcaagagccgcaaagtgcggtcggaatttgatacattgttcaaacattgcttctacattttttccgcctacgagtgcaaatgcatgatatttctgagggttattttcgataacagaaagggtactcttaccgattgatcccgttgaaccaagaatgacaatgttttgtttttgcatagaatctttaccgcacttttgttgattacattttcattggtacgtctaaatttgcatacctaataaaataaaggcagacaaaactgtctgcctttcgcattttttatgattagaaatccattaattctttttctttatccgctaatacttcatctacttttttaatgtaaatatctgtgattttttggatttcttcttctgctttatgttgttcgttttcgctgatttctttgtcttttaataatgctttgattttatcattcgcatcacgacgcacattacgaaccgcaactttaccttgttcaccttcgccttttacaattttgattaaatcgcgacgacgttcttctgttaatggcggaagcggaacacggattgtggtacccgctgaagatgggtttaaacctaaatctgaggttaaaattgctttttctaccgcagagattaaagaacgatcaaacacagttacggctaaagtacgcgcatcttctgccactacgtttgctaattggcgaagtggggtcgccgcaccgtaatattcaacttgaattgcatcaagtaaactcggttgagcacgaccagtacgaatttttgaaatatgaccttttaatgcttcaaggcttttttccatacgatcttgagcatcttttttaatttggttaagcattgcattgtcctttttaattgatgaaagttagaacgccgtgattttactggatttttttaaatttttgaatacatttatcagcttgaaaacagataaaaaatgaccgcacttcagttacccaaagtgcggttaatatttttagtatttttaattaagctttaggaccagctgcaattaaagctttgccttcttcgttagttgcatatttaacaaagtttttcacaaaacgacctgctaagtcttcagcttttgattgccattgtgctttatctgcgtaagtatcgcgaggwtctaagattgcagaatctacacctggtaatgctttaggaattgctaagttgaagattggcaattcgcccatttcagctttttcaattgagccatctaagattgcatcaatgattccacgagtatctttgattgagatacgtttgcctgtgccattccaaccagtatttactaagtaagcttcagcacccgctgcttgcatacgttttactaacacttcagcatattgagttgggtgaagggttaagaacgcagcaccgaaacatgctgagaaagttggagttggttcagtaataccacgttcagtccctgctaattttgcagtgaaaccagataagaagtagtatttagtttgttctggtgtcaatttagatactggtggtaatacgccaaatgcatctgcagttaagaaaatcactttagttgcgtgacctgcacgagaaactggttttacaatgttatcgatgtgataaattgggtaagacacgcgagtattttctgtttttgaaccatcatcgaaatcaacagaaccatctgaacgaacaaccacgttttctaataatgcgtcgcgacggatagcgcggtaaatatctggttcattttcttctgaaagatgaatggttttcgcataacaaccaccttcaaagttaaagatacccacatcatcccagccgtgttcatcgtcaccgattaattcacgttttggatccgttgaaagggttgttttacctgtgccagataagccgaagaagattgctacatcaccatctttaccaacgttagctgagcagtgcattgcaccaacacctttgagaggtaggaagtagttcatcattgaggacataccttttttcatttcgccgccgtaccaagtaccgccgattaattgaatgcgttcagtcaagttgaaagcaacaaagttttctgaatttaaaccttgttctttccagtttggattggttactttagaaccgttcattacaacgaaatctggttcaaaatttttgagttgttcttcagttgggcgaataaacatattttttacaaaatgtgcttgccacgctacttcagtgacaatacgtactgcaatacggtcgtgttcgctcgcaccacagaaaccatcaactacaaataagcgtttacgagaaagttggttagtcaccaagtcttttaagctttgccatgtagcttggttcattggcttgttgtcgttttttgctgtttcagatgtccaccaaacagtatcttttgttttttcatctaacacgatatatttatcttttggagaacgacctgtgaagatacctgtatctactgccactgcaccagtcgtagttaaagtacctttttcaaagccttctaagcctggtttagtttcttcttcgaacaattgctcgtagcttggattgtaaacaacttcttttacgtcataaatgccaagagcttcaagttcttttaccactttatttaagtctgtcataagtcacctctaatatataagattaaaatttaactgtggcttattataatggatgtcaatataaaaaaatgttaagtagatctcatttttaaacatttttttaagaactttacctctttttagtgatattgtgatatagagcaaaaatcccgacattgtgtcgggattgtttttaaactcttgttgattttaatttttcaatcgcttctttattaaagaagtagtgtgtgccacaacactcacattgcatatcaatacggcctttatgttcggctaatatttcgtcaatttcttcatcagagatgagcagtaatgcagaactagaacgctcagcagagcagccacagaaaaattgtacatcttgtgctggataaagattaacggtttcttcgtgatataaacgatagagtaactcttctgcagggagaccaaataattcttcatcttttactgttgctgcgagcgtagttaaatgctcaaaatcttctggtgtaccagaaccatcaggcataatttgtaataacatacctgctgccactggcttgccttcatattctccagtacgaataattaattgagtttgaagctgttctgagcgtacaaaataatcttctaagcattctgtgatcgtgggtttatccaagctaattacaccttgatagcgttcgccttcttttggtgcaatagtaatgaccaatacgcctttaccaatcatattatgcagactcatattttcagtgatgttgccatccactcgagcaagggcgcggatttgttgttgatcattaccatttactaatgctaagcgtaatgggccatcgccttgaatttgtacggtaatattgccggcaaattttagtgtggcagtgagtaaattagtcgctaccatcatttctcccaataaatcctgtactgctttaggatactgatgggtatttaatgtatcagtaaatgttttatttaagcgaacccattctccacgaactgcacgatgttggaaaagataacggtaaagtttgtcattgtcttgagtatagtcttgttgattggtcattgattattcctaattgmgataaaaagtgcggtggttttttccgcactttttgtcttgatcgttttatttaagtgtttttgcttataaataggtggcacttagaggcttgtaaaatccaatgtgatctctaagttataatattaattaagcaaatcttgttttggcttctgcaatagcttcggcaacacgcaatggcgatacgccaccttttgcacaacgtttgtctaagcaagattggagagaaagaatctcgtaaacgtcatctcccactacttcactaaattggcggaattcagggatagtcagatcttctaatcctttgcctttctcgattgcataaaccactgtttcgcctacgatatgatgggaatctcggaaaggtacgcctttagagactaaataatccgctaattcagttgcgtttgaatagccttttaacgcagcttcacgagtacgttcaacatttactttcaattcatctaagacgaacgttgccatatctacacagttttgccaagtatctaaggcatcaaaaataccctctttgtcttcttgcatatctttattatacgcaagtggcaagccttttaaggtgattaacatagatgttaatgaaccaattactctccccgttttgcctcgaattaactcacaagcatcgggatttttcttttgtggcattaatgatgaaccagaagtcacacgatcggatagttccacgaaatttgcttctccgctgttaaagataatcatatcttcagcaaagcgggaaagatgtgccatactaagagaggcgatggaaagtaattctacgatatgatcgcgatcagagacgctatctaagctatttctagttgcgaaagcaaaactaagatcgtgcgcaagtgaatcacgatctacagcataagccgtaccagccagcgcaccactaccaagtggacaagtattcatacgattatacgcatctgttaaacgtgaatagtcgcggtcgaacatttccacatatgccatacaccaatgggcaaaagttattggttgagctcgttgtaaatgggtatagccaggcattactgcttgttgtgtgttttctgcggtttgaactaagtgtcgttgcaaattacgtactgattcttgtaattcaatcacacgctgtttgcaccacagttttatatcgactgccacttgatcgttacggctacgaccagtatgtaattttttaccaaggttgcctactttatcaattagcttactttcaacccaactatgaatatcttcagcatcatcttgtaaaattgcttgcggatttgaccgcacttcaacaagtaattcatttagtgcttgctcaagttgatgctgttcttcgatagttaatacattgactttcaccaaggctttggaccaaccaatcgagccttgaatatcctgttctgccaaacggtaatcaaaccgtaatgaatcattaaaatctttaaaacgcttatctgcggcttgtgtaaaacgcccaccccaaagtgccataatttttcctttttgttttaattaattattctattattgtgcatatttattcataaagcaatattctatattaataataaaacaaaaatggacaaaatctttcattttgtccattttatttgtattagtgctatttatagcgtttttgccaaatttttgataaaggatttaaattctttacctaatttttcgtgacgaataccatattctacgaaagcttccatataaccaattttatcgccgcaatcaaaagtttcccctgtcatatgaaatgcttcaacggtttctttttcaattagcatatcaatagcatcggttaattggatttcatcgccaacaccaattggtgttttttctaacaaatcccaaattgctgctgaaaaaacataacgcccaaccacagcaagatttgatggtgcgtcttcaatagaaggtttttcaacaatactattaatttttgcactttcgccgccattaagctcaatgccaccacaatctgcaacaccatagctactcacattttcttgcggaactggggttaccataatttggcttgcgccagtttcattaaagcgttgaatcattgcagcaagattttcttttttctgatctgcactaaattcagctaataatacatctggtaacataacggcaaaagattcatttcctactaaaggacgaccgcataacacggcgtgacctaaacctttcgcattaccttgacgaacgtgcataatggttacattttttggacagatagaacgaacttcttctagaagctgacgcttcacacgtttttccagcatcgtttctaattcaaaagatgtatcaaaatggttttcgatagcattttttgatgaatgtgttaccagcacaatttcttttatgccagcagctacacattcatttaccacgtattgaattaacggtttatccaccaaagtgagcatttccttcggaatcgccttcgtggcgggcaacatacgtgtgccaagaccggcgacaggaataactgctttcatattatcatatccattgtttaactaagaggaacctaaatagggttcatctttcgtttgtttaattcgttggtaaatttcttctcggtgaacggatacttctttaggcgcttcaacaccgagtttaacttggtttccacgtacactcaaaaccgtgatagaaatatcatctccaataagtacactttcgccaactttacgagttaagattaacatcttttatctccttagtttgcatttattagatatcctatcaatcaaggaacggttggcattccaccaaccagcttgtactacagatttttgtttaaccagtcttgtgctactttaattgcttgtgtcacattttctagttgggaacctcctgccattgccatatctggacgaccaccgccttttcctccaacttgttgagccattaaattaacaagttctccagcttttattttggcggttagatcatttgtcactccaacgacgagattaactttttcatctaatattgatgcaaatgcaattacgcctgatccgagttgattttttaaatcatcgaccattacgcgtaatgattttgtttctataccatctaattgttgtgcgataacagaaacaccattgatttttaccgcactttttacaaaataagaacctgcctgcattgcggctttttcttttagaccttgcaattctttttccactttcttcgctttgtcttgaagttgctggattttttccgctaaggtatttacgtctgattttaataagtctgcgctttgggtcagaatgcgttgttgattatgtaaccagtcaatggcattttgacctgttacagcttcaatacgacgaatgcctgcagccactgcgttttcagtaataattttaaataaaccaatatcgcctgtgcgttttgcgtgaataccgccacacagctcaattgagaaatcgcccatggttaatacacgaaccttatcgccatatttttcgccaaagagagccattgctcctttcgcttttgcggaatcaatatccataatatctgtttgaactggaaagttagcgcggattttttggtttactaatgtttcaatttcactcaattgctctttggtaatggcttctggttgcgcaaagtcaaaacgtaaggctttatctgaaacaagcgaacctttttgcacaacgtgtaaacctagaatttgacgtaaggcagcgtgcaataagtgtgtcgctgagtgattgagtgatgtgttgtggcgacgtttagcatccacaatcgcattcactgattgtccaactttcaaacttccttgcgttaattctccaatgtgtccaaatacttgcccatatttttgggtatctttcacattaaaggttacactttgtgtgcttaaatatccgctatcgccaatctgaccacctgattctgcataaaatggcgtattttctaaaataacgaccgcactttgacctgcttcgatactttccactgatttaccatcatagaaaagtgcggtaatttttgcctgagattctacttcagtatagccttcaaacttagtttcgccatctacacgaataacgctgttgtagtccacaccaaactggctcgctgcttgagcacgagtacgttgcgcttccattttacggtcaaacgcttgttcatcaatagtaatattgcgctcacgacatacatcagccgttaaatccaatgggaaaccataagtatcataaagtttgaatgcaacttcacctgaaagaatgccatctttcacttgagaaagggcttcatctaataagctcaacccacgttctagagtgcgagcaaattgttcttcttctagacgtaatagtttttcaacatttgtttgttttgcttttacatcttttccagcttcagccattacatcaattagagttggcacgagtttatagaaaaaagattctttagcacctaataggtgaccgtgacgaactgcgcggcgaataatacgacgtaagacataaccacgcccttcatttgatgggataacgccatcggcgattaaatatgcacaagaacgaatatggtcagcaataacacgtagtgatttgttagttaaatctgttgcgcctacaatttccgccgtttttgcgattaatgttttgaaaatatcaatctcgtagtttgagttcacatgttgcaacacagcagaaatacgctctaaacccatacctgtatcaacagacggacgaggtaatttttccattgtgccatctgctaaacggttgaactgcataaacacaacgttccagatttcaatataacggtcgccatcttcttctggtgagcctggaggcccgccccaaatatgatcgccgtgatcgtagaaaatttcagtacaaggaccgcaaggacctgtgtcgcccattgcccagaagttgtctgatgcgtaaggtgagcctttattgtcaccaatgcgaataatgcgttcagcaggaacaccaacatctttattccaaatattataggcttcgtcgtcagtttcatacacggttacccagagtttttctttaggtaaaccaagccattgtggagaagttaaatattcccaagcaaaattaatggcatcctgtttaaagtaatcaccaaaactgaagttaccgagcatttcaaagaaagtatggtgacgtgcggtataaccaacattttctaagtcgttatgcttaccaccaggacgtacgcaacgttgcgcggtggtggctcgagaataagggcgtttatccattccaaggaacacatccttaaattggttcatcccagcgttcgtgaaaagcaaagtcggatcattttccggcacaagtgagctactctcaactacttggtgacctttgctatggaaaaaatcaaggaatgattgtcttatttctgctgttgttttcattaaaaagaatccttgttacccataataaaaataaaaactaagtcgccctatttttgcatatttttgaaatttataaaaaggctttttgccaaaactccaaaataaaaccgcacttcacgacgctatttgagaagtgcggttaaaatttaagttatttcagattattcaaaaaacaatttcttgttaattattcatctctaagtggaacaaccaacatatcaattttaatcgtattcatcacttgacgtgttgaagacattaacttactccaaaaatcctgatgatgtcccgtcactaataaatccacatcatattgttcgatggcatcacttaaaacttgtcctaaatcgccgctgccactcaatttttctgaaattggataatccacactttcagctaaatctaataaggctttttgtgtttccgtggaaatcctgtcttgcattgaagacatattcacatcaatcaatccagtataaagatccgaaaagttcacatcaacgtggatgatagaaagttttgcgtcgtggcgtttagcaatcccaactgcttttttaagtaaaattggactttcttcagaaagatctactgccactaaaatgtgtttgtacataatcgactccttaactgattggttcggtttttaactggctccaatgctaacattttgagcaataaaaaactgtgtactagatcacaatttaaacatttttattaaaaattcattaaattttcaatgtctgcaatttctttagggacagcagcggttaggattttattaccatattcagtcatcagtaaattatcctcaatgcgcacgccaatgcctttgtattgctctggcacatctgcatcttctgaaatataaataccaggctcaacggtaattaccataccgatttcgagtatccgttgtttatcttggccataactacccacatcatgcacatctaaccctagccagtgacctaatccgtgcatataaaattggcgataagcttgttgttcaataagtgtatccacatctcctttcaagatacctaaatccactaatccttgggttttaattcgaatgacttcatcattggcttgcttaatggaattgcccggtacaagtaattcaatcgcacgtttttgtgcttttaaaactaactcgtaaatttcacgttgaggctggctaaattttccatttacaggaaaagtgcgggtgatatcgcctgcatacatggcaaattcacagccagcgtcaatcagcactaaatccccatcatttagtgggcgatcattttctgtgtagtgcaaaatacaggcgttacttcctcctgcaacaatggaattgtaagaaggaaatcttgcgcaatggcgattaaattcatgcaaaatatcgctttcaatttcatattcaaagcgatttgggcgtgttgtttgcatcgctttaatatgcccaagtgccgtaatttgtcccgcttgttgcattaatcggatttcattcggcgattttataaggcgcatttcgctgagcattggtcgccaatctaaaatctcgctaaaattcaccgcactttctgacaccaatgtatcaccccaagtatgaatttctggcacatggtaaagtgcggtcaaatttttcagtatttttggcagtacggtagcgaattcttcaatagaataggcttcatttacattaagttgctgtggcgcacgctcaacacctaatcggcgaccattccaagtttcaagtaacggatcgcgtggacgaagaaaaataatggctttttctacttgttctgttttcagtaataacagtgctgcattcggttcattaaagcctgttaaataccaaaaatagctatcttgacggaaaggataggtacaatcattattacggcgtttttcgatttcagaaaaaagcaataatgccgaattaggttgcatttgagcgaatactcgtgtgcgacgttcctcaaattcttctttaggcaatttagccatataagccaattccattctagatctccttaatgtaatacaggtttgctctcaatttccccttcgttgaaatgagaatagaacaacattgcaatggtgcgaacatattcaatgatttcttctagtgcttccgcaagctcttcttcattatcatcttcatcataaccaagttggcaaatatcttgtaaatcatctacggcttcgccaatttcgcctttttcttttgctaattcaggttgtgctaagccaatcccaagtaagaattggtttgcccagtcagataggctatccgcttgtgtaaagacattttcatcttcggttaaaccaagttcaaaggtaaatccttcaacatctgataaggtttgactaatttgttcataaagttctgtaacgggttggactaatcctgttggataagcgtgattatcattgctgaattgatataagagcggtagccaactttgatcttttaatccaccacaaagtaaaccgcttaaaaagccgtgtagttctgttgcattaaagccgattccagcagatttaagttgttggttaaggtcagaatgagaaatgagcataatagatttcctgagtaaatttgaaattagtgtaaacctttgtaaataaaaaagccatcgcttgaccaattaaattagattaagaggctggtggtgcgtcacagcttttaacgctagaaatgaacctgatttatagatcttgtaatgacatttttattataaataatggcttatttaaatttaaactctgtccattgataatatcgcccgcctgctttttgaattccgccgtaattttgccattcaggatgatttggcgtatctggtaaacattgagtttctagtgctatgccagaaaaatcggcatataattcgccatttctcgttggtgtacctgcaagataattacccgtataaacctgcaatgcagcttgcgaggttcttacttccaaacttaaatcgccagttggagaggttagtaacacacaaggcttttgccaagctttattgacaataaaggaatgatcgtaaccctttgttgcttgctgatccccttgtaaaaaatcttgcttgatgggtttagcaatacggaagtcaaaacttgtattcaccacgtgctttaatggagaattaggaatcccctcattatctacaggcagataaaaatcagcatttaaacgtaatgtatgttcacgcacgtcactgccttgctctgcattttctaaattgaaataagtatgattcgttaggttcaatgcagtatccttatcgcacatccctgcatattcaatttttacgctattatcacctgttagcgtataggttacagacacatccacattaccaggaaaaccttgatcaccatccactgaatgtaatgaaaaacacacaaaattctcaccgcactcttgaatgttccaacggcgtttatcaaagccctctccaccatgaagctgatgtttaccttgattactacttaatttaataagttcgccattcaattcaaattgtgcatttgcaatacgatttgcataacgccctacgcttgcgcctaaatagctttgatgagtgggataattatctaccttacaacccaataaaacctcgcgtaatgtgtcatttactggcactttacaagaaagccaagttgcgccccaatccataaattgaacacgcatcccattttcattttgcagggttataagctgataaggtgcaccatcaggcgcattaaaagtggtttgttctaacattattttctcttaaatcactcgaacaccttgtgatgcggtacacacataaaaagtttcttttaaaccagtcgttttctcgtaattatccgcaataattttacgaactgaatcgactttatcatgcggtgcaagtgcgacaatacagccaccaaaaccgccgcccgtcatacgtgcaccgccacttttgccaataacaagttgagccaattcaactaaataatcaatttgtggcacggtgatttcaaaatcatcacgcattgaatcgtgagatgcttccattagtttacctaaacaagtcaaatcattgttcttcaatgcttccactgcatcaagtactcgttgattttctgttacgacatgacgagcacgttttgctgctaacggagaaagtgcggtcaattccgcttctcttttttggaattgctcaactgaaacatctcgtaatgctttcacgccaaaaaattttgctgcctcttcacattgctgacggcgagtattgtattcgcctgttactaaatcgtgcggtacgtttgaattcacaataatcacggcgacatcttgtggcactggtgttggcgtggtttcaagactacgacaatcgatcatcagtaagtgattttcctgcccaagtgcggaaattaactgatccatattgccacaattagcaccgacaaattggttttcagccttttgcccattcaatgcaatatccgtgtgagaaagcggtaaatcgccaagttgttggcagaatttacccaccgcaacttctaacgctgcagatgaacttaatccagaagaaagcggcacattaccagaaatcactaaatttgcaccttgttgaaaatctgggtaacgttcttggataaattttaccaccccacgcacgtaattagcccatttgtgttcactcttaggaatttcaacattgagagraaattcatcagtttcatcaagatctgcagcataaacattccaaatatgatcatctcgttttgtaccagaaacggccgtaccaaaattaattgcgcaaggcataacaaagccgtcgttgtagtcggtatgttcgccgatgatatttactctgccaggcgcatagacggtaatttctggcaaatttttatgctgtctattgaaaatttgttgagcattttggattggggtcatatttctatcctttatattaaatctatactcgatctgcacccctctttgctaaagctaaagaggnngactgactatattatttagttctttctttataatgaacttcactcaaagcacgtaatcgctctgctgcctgttctgccgttaaatcacgttggttttcgcctaacatttcatatcccaccataaatttacgcacggttgctgaacgcaaaagaggagggtaaaaatgagcatgtagctgccaatgttcgttatcttctccattaaacggtgccgcatgaaatcccattgaatatgggaaagaggtttcaaagagattgtcgtatttagtcgtcaattttttcaaaataaccgcaagatcttttgattgttcgtcacttaattcagttaaacgttttacatgagtttttggtaaaagcaatgtttcaaatggccaaatagcccaataaggcactaaagcgatccaatgttcagtttcaacgacaatacgttctttcaacgccaattctcgttttacataatcaaccaacattactgagccatgttttagcaaataatcacgttgtgtacgatcttcacgagcaacttcatttggcaagaaactattcgcccaaatttgaccatgtggatgtgggttcgaacaccccattgctgcccctttgttttcaaaaatttgcacccattggtatttcgcaccaagctcacgaagttgttcctgccatactttaatcacttcttcaatctcaagtgcggtcaataatggcaatgttttactatgatcgggagagaaacaaatgactcgactttccccacgagcttgagaactttggaaaagaggatcggaggatttttcaggggctggcgtatcttctaaaagcgcggaaaaatcatttttaaacacataaggtttacgataatctggatttaattcccctgtaatacgcttattactcgggcaaagataacaagttggatcataacttggtttttgttcttcattgactttttcctgttgcccttgccacgggcgtttggcacgatgtggtgataccaaaacccattgatcaattaacggattgtagcgacgatgtggatgttctgtaggttcaaaaagtgcggtcattttgactcctgttttttatcaatgtaaacgattacattaatttatactaaattattgtaaataaaccgtgatctttgtcacaaaataagaaaataagcaaaattttttatgatttagttcatacttatgaaagtaaccgctttcaatttatcgtaaattatttatgatcaaaatataagatttatagattataacaaggaaaaagttatgagtactattcgagatgtcgctaaattagccaatgtatctgtcgctaccgtatcccgagtattaaatcactctctttctgttagtgaaaatacacgccttgtggtggaacaagctattgcacagttagcttatcaacctaatgcaaatgctcaagcccttgctgtgcaaaacaccgatacaattggcgtggtggtaaccgatgtgacggatgccttttttgcgattttagtgaaagcggtggataaagtagcagaagcacatcaaaaaacgattcttatcggtattggttatcatcatgcggaaaaagagcgggaagcaattaataccttattacgtaagcgttgtagttctcttgttgtacattctaaagccttatctgatgatgaattaagccattatttaaatactgtgcaaggaatggtaatcattaaccgtgttattaaaggttatgaacatcgttgtgtcagtttagataaccaaaaaggcacttatttagccacggaaatgcttattcgttatgggcatcaacatattgcatatatcggttcaaatcacgccatttttgatgaagttgaaagaagaaatggttatcttgccgcattaaaagatcacaattatcccatcattgaacaggcgataacactcaatagcccagactttgaaggcggcgaaaaagcaatgattgatttacttagttataacaaaaatcttacggctgtcgttgcttataacgattcaatggcggcgggagccatttcagttctcaatgaaaacaatatcagcgtaccaagccaattttcaattattggttttgatgatatgccgattgcccgttatttgatcccaaaactaaccacaattcgctatcctattgatttaatggcaacttatgcggctaaattagcattaagtctaactgacgagaaaataattacacctccagtagttcaatttaaccctactttggtacgccgtttttcggtggaatcgcgctaatttgtgacatggatcacaaattcataattttttatgtaatcattttcatttttgcaaatttgctcatagattaattacgataatttatttatgatgtacacaaccttatctatccacatcaaccttccaaataggagtgttattatgaaaaaaacagccgtgttaagtaccgtcgctttcgctattgcattaggttcagcatctgcaagttttgctgcagataatcgtattggggtcacgatttataaatatgatgataactttatgtctttaatgcgcaaagaaattgataaagaagctaaagtagtcggtggcattaaactcttaatgaatgactctcaaaatgcacaatctattcaaaatgaccaagttgatatcttactctctaaaggcgtgaaagcacttgcgattaacttggtggacccagcggcagctccaactattattggcaaggcaaaatcagataatattcctgtcgtattctttaacaaagaccctggtgcaaaagctatcggttcttatgaacaggcttactatgtaggtactgatccaaaagaatcaggcttaattcaaggggatttaattgcaaaacaatggaaagcgaatccagctcttgacttaaataaagatggcaaaatccaatttgtattattaaaaggcgaacctggtcacccagatgcggaagtgcgtacaaaatatgttatagaagaacttaatgcgaaaggtatccaaactgaacaattatttattgatactggtatgtgggatgctgcaatggcgaaagataaagtagatgcttggttatctagctctaaagcgaacgacattgaagtcattatttctaacaacgatggtatggcattaggtgcgttagaagcaacaaaagcacacggtaaaaaattacctatctttggtgtggatgcgttaccagaagcattacaattgattagtaaaggcgaacttgcgggtacagtattaaacgatagtgtaaaccaaggtaaagcagttgttcaattatctaacaatttagcacaaggtaaatctgcaactgaaggtacaaaatgggaattaaaagatcgtgttgtacgcattccttatgttggtgtggataaagacaacttaggtgacttcttaaaataatttcccatcaatttttgttgtaatctaaggggaagtggatcttcccctttttaaagaggttggatatgacagctcaaactcaatgtcaagacagccaagtgctgctcacaatgaccaatgtctgcaagtcctttccgggcgtaaaagccttagataacgccaacttaacggttcgatcacattctgttcatgccttaatgggcgagaacggcgcgggcaaatctacattactaaaatgtttattcggtatttatgccaaagatgaaggcgaaattcttttcttaggcgaacccgtcaatttcaaaacatctaaagaagcccttgaaaatggtatttcaatggtgcaccaagaactcaacctcgtgcgtcaaactagcgtaatggataatttatggcttggacgctatccacttaaaggtccttttgttgatcacgccaaaatgtaccgtgatactaaagcgatttttgatgaattggatattgatgtagatccgaaagaaaaagtcgccaaactttcagtttctcaaatgcagatgatcgaaattgcgaaggcgttctcgtataacgctaaaatcgtaatcatggatgaaccaacatcctcgctttctgaaaaagaagttgagcatctgtttaaaattatcgacaaattaaaacaacgcggttgcggcattatttatatttctcacaaaatggatgaaatcttcaaaatctgtgatgaaattactattttacgcgacggtaaatggatcaacacggtaaacgtgaaagaatccacaatggaacaaattgttggaatgatggtagggcgtgaattaacacagcgtttccctgaaaaaaccaacgtgccaaaagaagttattttgcaggtggaaaatcttaccgctaaaaatcaaccatccattcaagacgtatcttttgaattacgcaaaggtgaaattctcggtattgcagggcttgtgggggctaaacgtaccgatatcgttgaagctatttttggcgtacgtgaattaatcgaaggaacgattaagttacacggaaaaactgtgaaaaatcataccgcacttgaagcgattaataatggctttgcattggttactgaagagcgtcgttcaacggggatttattctaatttaagtattgagtttaattcattgatttcaaatatgaaatcttatctcactccgtggaaattacttagcacgaagaagatgaaaagtgatacccagtgggtaattgattcaatgaatgttaaaacaccatcacacagaactacaattggttctctttctggtggtaaccaacaaaaagtcattattggtcgttggcttttaactcaacctgaaattttgatgctagatgagccgactcgtggtatcgatattggggcaaaatttgaaatttaccaacttattcaagaactcgctaaaaaagataaaggcattattatgatttcatcagaaatgccagaattactgggtgtgactgatcgcattttagtaatgagtaacggtaaattagcaggtatcgttgaaagcgcaaaaacatcgcaagaagaaattttgcaactcgcggcaaaatatttataaacataaggaatgaattatgagtgccttagaaaaaaacaaatcctttgatctcttaaaacaaaatgcgatttattttgtgttattgattttgctcggcatcatcattgcacaagatccgacattcttaaatttagtcaatttcagtaacatcttaacccaatcttctgtacgtttaattattgctttaggggttgcgggtttattgattacacaagggactgacttatctgcaggtcgtcaagttggtttggctgcagttatctctgcaacaatgttgcaatcaatggaaaatattaaccgcgtgttccctgaaatgggacaaataccaattccagtggttattctcgcagtttgtgctatcggtgcagtaattggtttagtgaatggtttagttatcgcttacttaaatgtaactccattcatcgcaaccatgggtacaatgatcatcatatatggtttcaactcactatactatgatgctgtaggtggttctccaatcgcaggttttagtgaaaatttctcaacatttgctcaaggattcttccgagtcggcagctttaaactctcttacatcacgatttatgcagctattgcagcattattagtatggattatgtggaacaaaactcgtttcggtaaaaacgtatttgctatcggtggtaacccagaagcagctaaagtatctggtgtaaacgttgcacgtaacttagttgcaatctatatgattgcaggtatgttctatgcctttggtggtatgcttgaagcgggtcgtatcggttctgcaactaacaacttaggttttatgtatgaattagatgctatcgccgcttgcgtagtgggtggtgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaataaagctgacgcaatcttaataaaatgaatgaaaagtgggcaaatttgtccacttttgttttatctattcaattctgaattaaggatatttatgcaataatcggcaaaccctgtataattgcgccaccattttcatagagagaaaaaaatgctaattaactttacacaagtattgcaagacagttggaatttcttccgtaatcagaaaaaaattatgctgcaatttgtcgcaattttatttattgtgcaaagcgcgagcgcacttttaagtttttcagttaatgatgaaaataaaaatgatgtattaaatctcgccaatacagatatcacaagttttatcttttcagttgcaatcactcaaattttaacgagctttattgcagcttggggattaacctcaatccataaaattagcctacaaaattaccgcactttaggtgaaaccttctcacttaccttgcgccgttttgcaggcgtaattctgttagatctattaatggttgcaccaatgttacttggtcttggtgaagcctttgctgcattactcacaaaaaaatcgccctctattatgtcacttatcgcgatgcttgttggcgtttggttctttgtccgtttaaatttaacggtagtacattatctttctactcaagaggcactttcgcaaactatccgaaaaatttggatgcgaggaaatactcgaaaaggcgtattgtttatttacaccctactggtttattttctcgtgccaattcttattttccaattaagcgcattttccaataatgctgtatttgatatggtaataggcattttcaccgcattacttaatattttcatgctagtagtgacttatcgtttctacagcttatttatgaaggattaatcaatatgaaacaactccttgactttatccctttaattttattttttatcacttacaaactcggtggtgtacgtgaagcagccatcgtattagtggttgcaacaattttgcagatcgtgattttaaaatggaaatacggaatggttgaaaaacaacaaaaaattatggcaagtgcggtcgttttttttggacttttaaccgcttactttaatgaaatccgctatttgcaatggaaagtgacaattatcaatggcttatttgctattgttttgctcgtcgcacaatttcaatttaaaaccccattaatcaaaaagttacttggtaaagagctacaattgcccgaaaaggcttggaatacattgaattttggttgggcaatattctttattatttgtatgttggtaaatatttatatcagccataatatgtcggaagaggcttgggttgatttcaaatctttcggaattattggtatgacagtgattgcaaccattatttcgggagtttatatttatcgttatttgcctaaagatggctcaaattcaaaagacggagagaaataatgtctgccaattttactgataaaaatggtcgccaatcaaaaggagttcttttactacgaactttggcgatgccttctgacaccaatgctaacggagatatttttggtggctggattatgtctcaaatggatatgggcggcgcgattttagcgaaagaaatcgcacacggacgcgtggttactgtcgccgttgaaagtatgaattttatcaaaccaatctctgtgggcgatgtggtttgttgctacggtcaatgtctcaaagttgggcgttcttccattaaaattaaagtagaagtatgggtaaaaaaagtggcgagtgagccaattggcgaacgttattgtgtcaccgatgcggtatttacttttgttgcagttgataataatggtcgctctcgcacgattccccgtgaaaataaccaagagttagaaaaagcattagccttaatttcagaacaacccttgtaaataaaaggaaatcattatgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctggttttacaggttcaaccgttattgctcaatttgaaaatctacaagcggcaaaagactgggctgcacaagatccttatgtagaagctggcgtatatgcggatgttattgtaaagccgtttaaaaaagtcttttaatttaaataacgtaatatgaaaaaagtcgccttaatttctctctgtatttttaccgcactttctgcttttgccgattcgcctaatacggcaacagcatcaatcaatcttgagcaagagaaacaaaactgggagctggcgcagcatcaagattatttaaaacgtctaaaacaacgtgaagtctttttgcaagttgaaggtttgctaaaaagtgcggtaaaaaaacagcaattttctgaagcgactcaaaatatcacaaaaaccttaatagactcattgcaaggctaccctttgcaatatgatctgcttgctcgattttgggagacaaaaatcgcctttttgcagaatgatgatattcaaggaagacaacaagcaataaatgaactcaatgcgttagtgcaacaaaattacccttttgtgacgccagcatttcaagccttattacaaaaactatccacgttaaacgaacaacaaacatcagcaacttcagataatgctaaagaaaataacagggttcaaaaagagcaaaatcaagtagaaaatcctaaacaacttgctgaaattgtaagaaaaagtgatcctaacactttagataaaaccgtattaattgatgctttcccacgttatcttaaaacgctacctgaacaaatgaataacctaagttttgaatcctatcaaaaatgggcaaatacttggcaactctcagaagatgaaattaaacagtggaaaatagcctttttaaatcgtttttttgataatgaaaacactgattttcaaaaatggcgtgatgaacaaatccgacaattacagactgataatttaaccgaacgccgtttacgaatggcaatttggcaaaaaactgaattaacctcttggctaaatttgctttctgccgaatcaaaaagtaagcaagaatggcgttattgggaagctaaacaagatatattaaaaaataccaaaaaactgaccgcactttcaaaagagcgtggcttttatccaatgttagcggctacacaattaaaacaagcatatcaactgaatgtccctattgcgccaagttttactcaagctgaacaacttccttttaagcaagtttttgcaatgattacagaattaagagaacttggacgaaatggtttagcaaaacaacgctggcgaattttacttgataatgttgatttcacaactcagctaaaactttctgaatatgccaaaaatcagcaatggtttgaattagctgttgatgcttctattgttgcaaaagcgtgggattacctgtctcttcgtctgccaaatgcttattctgaatacttcaatgctgcattacagaatttgaatatcagcaaaacttttgctatggcaatcgctcgtcaagaaagtgcttggaatccaatggcacaatcttcagcaaatgctcgaggcttaatgcagcttttgccaagtacggcaaaattgactgcagagaataatcaactaccttatcaaggcgaacaagatttattcaaaccattgaataatattttgctaggtaccgcacatcttaatgaactcaatggaaaatatcctaataatcgaatattgattgcagccgcttataatgcaggggcaaatcgagtaggaaaatggttaagtcgtgcgagtggaaaattagcattagatgaatttgttgcatctattcctttttatgaaactcgtggttatgtgcaaaatgtagtcgcttatgatttttactatcaaattttgcaaaataaagaaaacccacaaatctttagccaagaagaattgaatcggctatactaaatgcactagtttaatagtgtaaaatgggagcataattatgtatatcagccgtaatttagagcaatggaatgcatttcttcaaatgctaaaaattgcctttgaagaaaacaaagcgcaggaatttctaaccttattattaactgcagacgaacgagatgctgtaggattacgcttgcagattgtctctcagctgattgataaaaatatgcctcagcgtgaaattcaacaaaatctgaatacaagtgccgccacaatcactcgaggttccaatatgattaaaacgatggatcctgattttatgcaatggatgaaacaacatcttgatctcattgaaaaaaactaagcgaatttttaccgcactttctcacttatttagtcctaaatggtggaaaaaaaactggcagcgagttgtcttttgtttttttttcgccgtttttgctttgttgctgatttttcgctttgtacctattccattttccgcttatatggtacaacaaaaaatcgctaatcttttacaaggtgattttcgatatcaaatccaatataactgggttagcctagaaaatatctctccaaacattcaattagctgtgatttcatcagaagatcagcgttttcttgaacatttaggctttgattttgaggctatccaacgagcaattcggtataacgaaaaatctaacaaaggaatccgaggggcatcaactatttcccagcaaactgctaaaaacttaatgctttggcacggacaaaattggctacgaaaaggtttagaagttccagcgactatgttgcttgagctgacttggtcgaaaaaacgtattttagaagtgtatttaaatattgcggaatttggaaacggcatttttggtgtggaagcggcaagtcgctattactttaaaaaatcagctaaaaatttatctcaaaatgaagccgcacttttagctgctgtgttgcccaatccaatcatttataaagtaaataagccaagcttattagttcgtaaaaaacaaacttggattttgagacaaatgggaaatttaggcactgaatacttgagccatttataaaaaatgcaatcgaatttctaaagtacaacaaactaaaaaatatttacttaatacacaaaataaaaaacgagtctaagactcggttttttatttataacatttttattacaagtttattaccgcaaataacacccaaacggtataaattgtggctaaaccataaaagataaatccaccagctggcacatgcactttaagatcgtgcataccgtgatgaatacggtgtaaaccacaccacattgggaaaatagtaagcactaaaataactaatttaccaatccaagaataagcaaaagtaattaaattatgcacatcgactaaaccaaatggtaataacaaaccgatgattagaataacgacaggaaggaaaattgcactcactgtgccgcccgcaccgaacattaaccatactggcggttcgccggagcgttttggattttgatcaaccattttttctctcccttaaatataaactaaaactaacgcaatcacgctaactaatgcggttaccgcccaaagtgcatttcttacaactgtgtgtggtaagcgttcatttttcacaatgatattcatcacttttggtgtcattaagaaatatgtcaccgtatgataaagcgttgcgataagcgtaataatatttaagaacactacaatagggtttcttaaaaactcaataaagctcaagatgcctaagcctggcattggattgcttgcaaaacaaagaacaccataaagcaatacaatacaaaaccatacagcaaagactgaagtcgcttcacgtagcatataagctttgtagaagtccaatttttgccaccaagtcgctgtcattggacgaacatattttttacgtttactcactgttactgacattccttcccccttagccttttggttttagcatagagataacataatctttggcactttccacttttccttggttaattgcagaagcaggatccacatgttttggacaaacttctgagcaatagccaacgaaagtacaactccaaaccccgtttttaccatttaataatgacatacgttttgctttaccatggtcacggttatcaagattataacgatgagccatcgtaatcgctgctgggcctaagaattcaggatttaaaccaaattgagggcaagcggcatagcataaaccacagttgatacacattgagaattgacgatatttctcaagctgtgctggcgtttgtttagtacggctaacttgcaattctttcgatggatgtggtttaccatctaatgctggtgcttcgttaccaataatataaggcttaattgcctctaaactttcgataaagtggcttaaatcaaccactaagtcgcgttcaatagggaagtttgctaatggctcgatacgcatatggccgctgtaatcacgtaagaaagttttacaagccaattttggtttgttatttaccatcatcccgcaagaaccgcagatcgccatacggcaagaccaacgataagaaagagatggttcaagtttatccttaatatagcctaacgcatcaagcaatgaagtttgattatcataaggtacttgataggtgcttaaatgtggctcttgatcgatttcaggattgtagcgtaatacttcaacattcattactggtgaattagccatttgcttgctccttagctttcgcagctgcttcttgagcttctgcttccgcaccgtaaacacgttttgcaggttgagatttagtaattttcaccggactgtattcaatgcgcggcgcaccattctcattgtagaaagcaagtgtgtgttttaaataattgacatcgtcacgttctgtgtaatctaagcgttggtgagcaccacgagattctttacgttcaatcgctgaatttgcaatagattgcgcaacatctagaatgtaacccaactcaacggtgtaaagtacatctgtattgaacacgcttgaattatctgatacgcgaatacgtttgtaacgttcttttaactctgcaattttatctactgctttttgcatacttgcttggtcacggtaaataccacaaccttcttccatcacggtacccatttcatcacggatttcagaccaagattcattaccttcttgtttgtgaagagcttctaggcgagctacaacgtcttttgcttgagcatcaaccgcactttgatttacagattgagcttcaactgcacgttgtgccgcatactcccctgcaacacgacctaacacaacaagttcagctaaagagttagatcctaaacgatttgcgccgtgtaaacctgaagatgcacattctcctacagcaaataaacctttgatacgtgtttcgctgttaaaatcaacttcaattccgcccatggtgtagtgaacaactggacgaacagggattggttcattcactggatttacaccttcataagcacttgctaattcacaaatgaatggcagacgctcatgtaaatatttttcaccaagatgacgtaaatctaaatgcaccacatctacgcctttcgcggtttttaaggtattaccttttttccattcttgccagaatgcttgagaaactttatcacgagggccaagttccatatatttattttgcggtttgccaattggtgtttcaggacctagaccgtaatcttgaagatagcgatagccatctttattcactaagataccaccttcaccacgacaaccttcagtcattaaaatacccgtattaggtaagcctgttggatgatattgaacaaactccatatcacgaagtggtacaccgtgacgatatgccatagataagccgtcacctgttacaatgccgccattggtattaaatttaaatgcacgacaaccaccaccagttgcgataacaaccgcattggcattaatttgaacaagtgaaccttccatcatattcattgcaaccataccacgagcatggccatcatcaacaagaatatctaatacgaagtgttcatcaaaacgttggatttgtggatattgaatagaagtttggaaaagcgtgtgtaataagtggaaacctgttttatctgcagcgaaccaagtgcgctcaattttcattccaccgaaacsacgtacgtttacatcgccatcagctttacgactccaaggacatccccaacgttctaattgagtcatttctacaggggaatgttgcacgaaatattccactacatcttgctcacaaagccagtccccaccagcaacggtatcttggaagtgtttatcgtaagaatcttcttctttgataactgccgctgcgccaccttctgctgctacagtatgcgtacgcattgggtatactttagaaactaatgcaatttttaagttaggatttgcttctgctgcggcaatcgctgcacgtaaaccaccgccaccagcaccaacaatcgcaatatcgacattaactgtttgcacgatatcctccaatcaatagaaagtaaaaataaatcccctaaaagggtaatattgtgtgggcattgtgccatttttcgttacaaattaataacgtnttttatgtctaaagatggaaangtatcggattttgtgatctacctcaaaaaagctaagattgagttgagagtagctctcgtttacaatgtgcaaaatttttaaaacaggattaaaaatgaccgcacttaatcattggcaaccttctgctgatataaaaaatctycttaaacgggcaaaaattattgctaaaattcgtcaattttttacagaacgcggtttgcttgaagtagagacccctgttctaagtgaatttggcgtcactgatttacatctttccacctttagcacggaatttctcgcgcctttcggtgaacaatccaaaacactttggctttctacaagccctgaatatcatatgaaacgcttgcttgctgcaggcagtgggccgatattccaaatcagtaaagtgtttcgcaacgaagaggctggaaatcgccataatccagaattcactatgttggaatggtatcgaccgcactttcatatgcatcgtttaattaatgaagtagatgatttgctccaacaaattttagattgtccacctgcagaaagtttaagctatcagtttgttttccaagaatatgtaggcttagatcccttgtcagcagaacgttcagaattaattgaagcagcacgtaaacataattttatggctgaagataatgaagatcgcgatacgttattacagtttttatttagtgaagtcgttgagcctcaaattggaaaagaacgacctattgccgtgtatcatttcccttcaacacaagcagctctagcacaagtaagcccagaagatcagcgggtagcagaacgctttgagttctattataaaggtttagaattagccaatggttttcacgaacttgccgatgcgcaagaacaacgtcatcgctttgaattagataatcaacaaagacaaaaatgtgaattgcctactcgagaaattgatgaacgctttcttgctgccttagaagcgggtatgccagatgcttcaggtgtcgcattaggaatagatcgtttaatgatgatcgctttagattgtgaaaaaattaatgacgttatttcttttgctgtggacaatgcttaaaggtaaaagtgcggtaaaaattatcatcatttttatttaatgggtgatccataatggcaattttatattcattgatagcccgcctaatatttctttttgataattaacaatattcgcttcttttaatgggggaataaattctgagatcgaaattaggtacagtgatcacaaggctcatcattatgaaaaaaagaaaaccaaaacataagaaatgtttggatagtgagttgatttaaattgaaaaaataacctaatttcataaaaattaggtaactaaagcgtatccttttccgcgtaaagttttaaaccaagagggcttgttttttcgttttggtaatttgcgtcttaaattagagatgtgcatatcaagagaacggtcaaatggagtgagcggtttttccattacttctaaacttaattcttctcgacttaccacatttcccttagatttaagcaataaacaaagaatcttaaattcataatccgttaaatttagattttcttcattataggttgcaattccgtgagaaaagtggagagtaattccgtcaaaagaaaggatttctacatttgatatattatttgaaggagatgcactacgacgcaaaatcgccttaattcttgcaataagttcacgatcgttaaaaggcttgggtaaacaatcatccgctcccaattctaagcctaatacgcgatcaatgtcttcgcctcttgctgttagcatcatcactggcacgttagagactttacgaatttcttttaatgtttcgataccatttaactttggcatcattacatcaagtaaaaccagtttatagctttcattgagtttttgtaatgcttctaatccattatttgcagtttcaacgtcaaaaccctcaagttctaaaagtgtagaaagtagttcagttaattcaatatcatcatcaacgagtaagagttttgacattggagattccttttaccaattattcttattgtagtgtggtgaaaataaaaagattatttccagaatttccaccagcttgattttggtttctcacctgtttcaataatggtgttattttcgccttgttgtgaaacctgtggtaaaggtttatcaagatgggtttctgtcacaatcccacgttgatcaaattttactgtgaaagtatgttgaactggcgtttcataggcacgttgttgtaagaacacatagtaccaagtctgactattataaggatcgactaatactggcgtacccaacaaatattgtacttgttgagcagtcattccttctttaacttgcgcaacggtagtcgcctctaaatagttgccttgcggtacatcaattcgatatacaactttttcaacggtggaacaagaagcgaggcttaatgctaaaaaggttgcgcctaaaagtgttttaacttgcattttctttaccttaatttgtgcaaaagttctgtcaaataatatccaaaattgggtgtatttccaaattaattctctgattttaaagccttttgtaattgatcttttaaatttggtggtaagcctttgatggttagggtatctgtcataggatcccattgaatacgtgtattcaataattccgcatcaaaacttagggtaacgccctttcctgacccagagaattttgttagcgatttcaatgttgaacgtattggtggaatactctcttccaaaccataattctgtttttccgtaaagacgacaaaaggctgttcgtttagagtgggtaatgaatcagaaagttcccttaattcaatattgttaccatttgaaagctgacctttacaatattcaaacacttgtttttttaccgcttgagtttgctctttgttgagttcgccttgatcgcagtaatcactcacagcttgcaataaacattgattttgaacttgtggatttaatccttcttcggcacctaaaaaatccataaaaaaatcactaattttgcgaccaacacgaccttttataaaggttaaataacgattagagttcgcatttacttgcaaatccgtcaaatttatccgtgccgcaatatcaaactgagtaatatccaaatattctgtacggcgaatatctaaatgctcatcgactaacatactatgacgactatcaagcaatgcaataaacaagtaatctgtcgctaagaaattatattgacataaaatcaaggtgccactttccgcaaagttatatttacctagctcatctgcaagcaattttgttgaatattgactaaaacccaaaaactcaatttcttgctctaataaacgatttaaatgttgtgcaaatatagacttttcctgaaacacgccaaaagccttagctttattttgatagctttgatgcaattgcaacatcatttgttctacttctggtgtaatggacagcaactcgtcgcgtaatacgctttccatttttatactgtcgccatccacatttttgactaactgatgcaaaacagtttgattaacggtaatactcatttttgtcacctttgaaaaatttgccgcaaattataaccgcactttttcagcaagaaaaaagaaattatttaggttctaccaaataatcgggtatcataagccaaattttttttatttttaacattatggctcaacattctaaatattctgatgctcaattaagtgcgattgtaaacgatatgatcgcagtgctagaaaagcataaagcccctgtagatctttcgttaatcgcactgggtaacatggcgagtaatttattaaccaccagcgtgccacaaactcaatgtgaggcattagctcaagcgttttcgaactccttaattaatgcggtaaaaacacgttaatatgaaatggattaaaaaaggcaccttcagcggcaaacaataccgcgatgacgtttcacgaaaaatttcgtggggtcattggtttgccttttttaatatcattgttgctatttttattggcgcacgttatgcctttatcattgactggccagatactctcgcaggaaaactttatttctttgtgagtttgctcgggcatttcagtttcaatgtttttgcgttgtacttactcgtggtctttcctctgagtttcattgttaaaaatcaccgcacttttcgcggattaaccgtgattttttctacgatttgtacaaccttattgttatttgataccgccgttttcaatcgttttaatctgcatttatcctctgttgtatggaatttgctggtcaatccagaaaatggtgaaatgtcacgcgattggcaaattttctttgcacctatgccaataattttactggcacaaatgttattttctcgctggagttgggaaaagttacgtagtcttgaacgccaaaaatggctaaaaggcactggtatattcttaaccacaacattcatcgcgacgcatttaatttatgcttgggcagatgcttatttgtatcgtccgatcaccatgcaacgctctaattttcctttatcttatccaatgacagctcgttcttttttagaaaaacacggtttcttggatggggaagaatatacgcaaaaattggcgcaagaaggtcgtttagatgctttaaaaattgattatccgaaaaaagaactcacttacgcaccaattacgcacaaacctaatattctgctcgtaacggtttcgggtttacgccatgatgcgatttctaatgaaaagatgccaaaacttgctaaatttgcaacaagctcaacggaatttactaatcattacagcacaggcaatagtaataacgcaggcttaattgggttattttacgggctaaatgcaaattacaccgatagcattttaagcaatcatacccaatctgttttaatcgaaaaattacgtgctgaaaattatcaattgggtttattttctgctacgaatttcaaagatagcatcttccgccaagcattatttcgtgaaataaaactttcatcgaataaaaccaacaaaccaaataatgaaagtgcggtaaaaaatctcaatgattttattaaagcacaaaaaactgactcaccttggtttgcttatttggatttagccttggaggctaaaaatccatcagattatgaccgcactttgcaagacattgattctcttttagcaaaagcgttagaaagtacaccgcttgaaaatacattagtcatcatcacgtcagagcatggtttaacctttaatgaaatgaatcaaaaagagcgagaaaactactttgggcgtgatgaaattcaagtgccattgcttgtatattggaaagatttaccagtaggtaaacaaaatggattaagtaatcatgcggatattttctctgcattaatgcagacagtattccgtgtagaaaacccgttgatggattatagtcagggacgcaatctctttgatcttaaaggagatgactgggtacttgcctcgaatttccgctggaatgtggtgattcaacctgatggaacacaatatcacattgatcgcaaaggtaattacaaaaaattcgataaagattatattgagcaatcttcagacagaccgccacttggaatttttttagaagccttccaattacaaaatttcttctttgaaaaataatctataagtgcacaaaagaatggattttttgcccttaagtctttatactcacgcctcagtttaagactgaaaaatgttattaatgaaaatccgtgagtttttcataacattatcataatgcttctcgccgtacttacagtacctttcaattaatatacattctcgtctttttatcctttcttttttacggagtttgtatgaaaagccatgttcgtagttttaaaacctatattcgcgatgaaattatcaaaaaaggcgggtgggtaaatgcccatgctcatgctgaccgcgcttttacgatgacgccagagaaaattgggatttatcatagtagtaatttgcaacaaaaatgggatttagtggatgaagtaaaacgcacttccagtgttgatgattattacgcacgtttttgccaatctattgaattaatgatatcccaaggtgtaaccgcatttggtacttttgtcgatatagacccaatttgtgaagatcgtgcaattattgccgcacacaaagcccgcgaagtgtataaacatgacattattttaaaatttgccaatcaaactttaaaaggggtaatcgaacccactgcgcgtaaatggtttgatattggtgcagaaatggtagatatgattggtggcttaccatatcgtgatgaattggattatggacgtggcttagaagcgatggatatcttgttagataaggccaaatctcttggaattatgtgtcatgtacatgtagaccaattcaacaatccaagtgaaaaagaaaccgagcaactttgcgacaaaaccattgaacacggaatggaggggcgagttgtaggtatccatggtatttccattggctcacattcaaaagaatatcgctacaaactttacgaaaaaatgcgtaaagccaaaatgatgatgatagcctgtcctatggcatggattgacagtaatcgcaaagaagatcttatgccattccataatgcgctcacgccagcagatgaaatgatccccgaagtatcactgttgccctaggcacagataatatttgtgattacatggttcctctatgtgaaggcgatttatggcaagaattaagcctattagctgctggctgccgtttcccacacttagatgaaatggtcaatatcgcaagtattaacggtcgtaaagtgttaggactagagctaatttagttgcgtatggtgggtttaagccagctagttaccataactattttaaaacccagaaaaacgcgtaaaagtgaaagaattgattgcgatatttggtgctcgtaaataataaaaataaaccgcacttttgttagtgttcggttagatgactgttttctttaaatcatctagtgtattaaaattctcgaagttgccttcttcttgcgtgaattttactgaaatcccgccattttctttcataaattgtaaaaggcgtcgttcacccgatgctaaatagtgtcgcaatttttcctttagctgaacggacattaaacaaaaaacgggatgttcacgttcttcatcgcaagcatacgcaattaaagtgcggtcatttttaaccgcacttttgagtttatctaaaagattcataggaaaaaaaggcgtatcacaaggtgtaaaaaggataaagtcgctttttgtcttttctagagctgttagcatgccacttaatggcccttgaaaatcgggcagttcatcggagaaaacaggaaagccaaattttgcatattctgtttgatttcggttagcgttaattgaaatctgatgaatttgtggttgtaagcgattaataatatgttcaattaaagattgtttacctaaaatctgtaatcctttatcttgcccgcccattctacgagccttgccacctgccaaaattactgcgcttattgtaattgtcatattttaatctatcattatttcaagtatcatttgcctattttttacgattaaaaaggaaatagcaatgaaataaaaaggaaatagcaatgaaatgtaagcgtttaaatgaagttttggaacttttacagtcttattggtctaaagactcggatttgagtttaatggaaattttgcaaaaaattgccaatgaatcaggtttccaaaaaccattaaatgaattaactgatgaagtgattatttatcagttaaaaatggatggtacagataaatatgagccaattcctggtctcaaaaaagattacgaagaagattttaaaaccgcattgctccgtgctcgcggtatcattaaataagaggaaagaaatgaaaaaagtattacttgcgttaggtttaggtgtcagcacgcttatgtctgtaaatagttttgccgcagatttacaagaaggcaaacaatatgttcaagtgagtcaacaggcttcacagcaaaaagaagtgattgagtttttctcattctattgcccgcattgttacgcctttgaaatggaatacaaaattccacaacaagtcgtagatgctttaccaaaagatgtgaaatttaaacaatatcatgtaaatttcttaggtcatcaatctgaaaacttaacacgtgcttgggcgttagcaatggcattaggtgcagaaagtaaagtaaaatcaccattatttgaagcggctcaaaaggatgccttgaaatcaatggatgatattcgagctatcttcttatcgaatggcataaccgccgagcaatttgatggtggcattaatagttttgcagtaaatggtttagttaataaacaagtgaatgcagcagaacaatttaaagtgcgtggcgtacctgatttttatgtaaatggaaaattccgtgtaaaccctgaagggttaaattatgatgatttcgtgaaagattatgtgcaaaccgtaaaaggtttattgcaaaaataacgaaaaattggtttaatgccagccctattttgtaaatattaatgaaagaagagagaatattatggctgcaagttttagcgtaacgcgtcgtttctttgacgacaaaaactacccacgtggtttttcccgtcacggtgattacacaattaaagaatcacaggtgcttgagcaatatggtcaagcgttcaaagcattagacttaggggaacgtgagccagcgactaaagaagaaaaagatttcgtcgcattttgccgtggtgagcgcgcagcagagactttctttgaaaaaacttggaataaatatcgtactcgtattaacactaaaaaacgtgtttacaccttatctagtgatgtgagtgaagctgcctctggcggtgaagattattccggcgaataagatacgttaaataaggcaggcggaagtctgccttttgtttttgaatagcttgtgaaatcacgcgtaattcacggctgataactttattctcctatctttgtatgaacgattcgtcttcatacaccctatgaatactaatttctatgcaattaccgatttctcaatacaacgaactgctacaaaaaaaacttgaaaaattaaccgcacttttacacccttttaatgcaccagatattcaagtttttgactctccaacaagtcattatcgcatgcgtgcggagtttcgtatttggcacgagcaagatgatttttaccatattatgtttgatcaagcgacgctgcagcgttatcgcgtggatgaatttccaatcgccagcatgctaattaatcgtatgatgcaaaccttattacctttgttaaaacaacaagaagtgctacacaaaaaattattccaaattgattaccttagcaccttgagtaataagattattgtgagcttgctttatcataaaacactcactgaagaatgggaaagtgcggctaaaaatttgaaagatttactcgaaaagcaagattttgatgtgcaaataatcgggcgtgcaagtaaacaaaaaatctgttttgagcaagattatgtggacgaagttttacctgtgaatggcagaaattatgtctatcgccaagtcgagaatagttttacccagccaaacgcaacggtaaactgcaaaatgcttgaatgggcaattgattgtacccaaaatagcgaaggtgatttattagagctttactgcggaaacggtaatttttctatcgcacttgcacaaaatttccgtaaggtattggcaacagaaatcgccaaaccttccgtagccgccgcacaatttaatattgctgaaaataaagtggataatttacaaattatccgtatgtcggcagaggaatttacgcaggcaatgaatggggttagagcctttaaccgcttgaaagggattgatttaaaatcttatgaatgtaataccatttttgtcgatccgcctcgtgcggggcttgatcctgatacagtgaaacttgtacaaaattacgatcgcattttgtatatttcctgtaatccacatacgctgtgtgataatcttgttgaactatcaaaaacgcaccgcattgaaaaagcggcgttatttgaccaattcccttatactgaccacatggaaagcggcctatggctcattcgcaagtaggaattcagctgatttctgaatcgacagaaaaaacattagcagaattgatcgcactttgtgctgaacacaacattattcataatgaaaagagcccacttgcacttgttcaaaccgatgaccgtttagaacttcgtaaactagacgaacctaaactcggagcggtttatgttgattttgttggtggcacaatggctcaccgtcgtaaattcggtggtggacgtggagaagccgtagcgaaagcagtagggattaaaggttcggcattgccaacggttattgatgcaacagctggtctaggacgtgatgcctttgtgttagccgcaattggctgccaagttcgtttagtagaacgccatcctgttgtttttttacttctgcaagatggtttaaatcgtgcttatcaagatgaggaaatcggcgagatgttgcaacaaaatttgcacttgctgaatgttcagcatattaatgaacttgatcctaatagcgattatgccgatgtggtttatctcgatccaatgtatccgcataaacaaaaatctgcactagtaaaaaaggaaatgcgtgtattccagcatttagtcggggctgatttagatgctgatgaattgcttttacctgcactccaattagctaaaaaacgtgtggtcgtgaagcgtcctgactatgcggaatttctttgtggaaaacaaccgcactttagccatgaaacgaaaaatcatcgctttgatatttatatgggagcatcccaatgctaagagaaagtgccgttgttattagctatgaaaatggcattgccaaagtgaaatgccaatcccaaagtgcctgtggccaatgcgcagctaaaaacagttgtggaacatcaagcctttccgaattaaacggtaaacgtggcgagcatatttttaatgtggaaacattaatgccattacgcgaaggtcaaattgttgaaattggattagaagaaaagtcgatgttgttgtcggcattattgatgtatgttgtaccgcttttgaccttattgattgtgactatgttgtccgattacataagcgataatgaaattctgcgtgccattttaatctttggattaaccgcactttctttcattttggtaaaatcttatagcagaaaattagggcaacaaacagaatttcagcctgttttattgcgtgtattatcttgagttttttactcgctttttattattactgcgatttagatcgcaaactataaagctagttatttaaattacccattgaaaaaagctctttagaggcttggtcaaaacttagtgatgatgtggcaaaagttgctattctagcaatgcctgttatactttatggcgagcaaccgcttttcctaaaaggatgaaatattatttttttgctcattattgcttatgcttgccttgtgatggggcgtaaatttcgtcaattagtggagggaaaataatatgtggcttactatagggcttggcattgtttcgcttcttgctattggcggacttatttttgccaattatgcagcaaaacattcttaatttattaaccccgatctttcggggttttccgtatctaaagtgcggtgatttttaaggttatttttatgaacaatcagattcctttacttggaattaccggttatagcggtagtggtaaaacaacattattagaaaaacttatcccagaactgatcgctcgtcacattcgcgtttcagtgattaaacatagccatcacaatatgcaagttgataaggaaggaaaagatagctggcgtatgaaagaggcgggttcttctcaagtcattttagcgaatgatgaacgctgggcgattatgacggaaacgccaaaacctgtttcattggattatttagcgcaacaatttgaccgcactttaacggatttagtgttggtagaggggtttaaacaagagccaattccaaagattttgctccatcgtcaagaaatgacaaaacctttacccgaaattgacgaatatgtgctcgcagttgcaactaattatccccttgaaattgaccgcactttgttggatattaaccgcattccgcaaattgccgattttattgaaaattggttgcaccattttcacggagcacgatgactactgaatccaatgcctatcgcggtttagcttgggtagcagcaatggcactttttatgcaaagcctcgatgcgaccattctaaatacagctttacccgcgatatcttccgatttacataaacccgcctttgaaatgcaaatggcgattattgcttattctttagctgttgcattatttattcctcttaccgcttgggctgcggcaaaatttgggacattaaccgtttttcgtagtgcagttttcacgtttattttaggttcagttgcttgtgccgcggcctctaatttagagagccttattttagcccgagtgattcaggggataggcggtgcctttatgatgccggtggcgcgtttagctattattcaagctgtccccaaacaacaattagtgaatgcttggaatttaatggcaactgcaggtttgattgggccaattctagggcctattttaggtggatggttagtcattcacgccagttggcactggatttttttaattaatattccaattggtgcgctaggaattttggcatcgggcagcgtgatgaacaatatcaagggcaaggcagaaaaattagattggacaggttttttactctttgcattggggttagttggtattacgcttggtttggatttactcggcgaaagtcagcataattcaagtgtaacttatagcatattagttgttggtattctgttactcgtaacttattgtggctatgctaaaaacaatgaaaatgccattttacctttatcccttttccgaactcgtacattcagattaggtattattgccaatatttttatccgattatctgcatctggtgtgccctttttattgcctttgatgttccaattatctttcggttacagtgctgaaatgtctggctggctattagcaccgattgcgttaatttctgtgatgttgaaaatattaattggacgaattttaaatcgttggggttataaaaccacgttaatttcatccgcacttttgatggcaggttctgtgatttcaatggcttggttagataaacaaagctctctaacttggattatttgtaatcttatgtggtatggggcttgtatgtcgatcatttttacttcaattaatacgctggctgtaggcgatctttcaaaacaacagtctggcacaggctctaccgtattaagtattgtacagcaagttgggattggatttggtattgctgtgtcatcaataatcttaaatctttatcgacatttctttagcgcaagtgattgcttaccacaggcattcagctatacttttttaacttcatcactttttgtaatcgcccttgtttggtcgcttatgaaattacataaacatgatggcgatcatttacgaaaaatgccttagattaatttgttataatccatagaatttttttatttaaaaaaagggaaatttgcttatatcttattgatatttcttgttggtggagatagctccatcgtttaaccataaatggtagggcattccctgcctaacattgaggtatgcttatgaaactaaaagcaacattaactctcgccgctgcaactcttgttttggcagcttgtgatcaatctagctcggcaaataaatctaccgctcaaactgaagcaaaatcctcgtcaaataatactttcgtttattgcacagcgaaagctccattgggatttagccctgcgttaataattgaaggtacttcttataatgcaagctcacaacaagtgtataaccgcttagttgaatttaaaaaaggctcaacggatattgaaccagctttagctgaaagttgggaaattagcgatgatggtttaagttatacttttcatttaagaaagggtgttaaattccatacaacaaaagaatttaccccgacacgtgattttaatgcagatgatgttgtattttcattccagcgtcagttagatccaaatcatccatatcacaatgtatctaaggggacttatccatattttaaagcaatgaaattccctgaattgttgaaatcagtggagaaagtagacgataacacaattcgtattaccttaaacaagacagatgcgactttcttggctagtcttggtatggattttatttctatttattctgcagaatatgctgattcaatgctgaaagcgggtaaaccagaaacacttgatagtcgcccagtggggacaggcccttttgtttttgtggattataaaacagatcaagccatacaatatgttgcgcatgaaaattattggaaaggtagaacacctttagatcgtttagtcattagcattgtgcctgatgcaacaacacgttatgcaaaattacaggcgggtacttgcgatttaattttattcccaaatgtagcggatttagccaaaatgaaaaccgatccaaaagtacaacttttggaacaaaaaggtttgaacgtagcgtatatcgcattcaataccgaaaaagcaccgtttgataatgtcaaagtgcgccaagcgttgaattacgcagtggataaaaaagcgattattgaagcggtttatcaaggcgcaggaacatcagctaaaaacccacttcctccaacaatttggagttataatgatgaaatccaagattatccgtacgatccagaaaaagcaaaacaacttttagcagaagcgggttatccaaatggttttgaaactgatttctggattcaacctgttattcgtgcttctaatccaaatccaaaacgtatggctgaattaattatggcggattgggcgaaaattggtgtaaaaactaacccagtgacttatgaatgggctgattatagaaaacgagcaaaagagggagaattaactgcgggtatctttggttggtctggcgacaatggcgatcctgataatttcttatccccattattaggtagctcaaatataggtaattctaatatggcacgtttcaataattcagaatttgatgctttactcaatgaggctattggattaaccaataaggaagaacgtgcgaaactttataaacaagctcaagttattgtccataatcaagcaccttggattccagttgcccactctgttggttttgcaccacttagtcctcgtgtaaaaggttatgtacaaagcccatttggctatgacgctttttatggtgtgagtgttgatggtaaataattcatattgatttacttattttaagcccttatttataagggctttttatttatcaaggattattctgtaaaaaatatgttaaataactttaacttgagtataatgctcagcattatttctatcgaatatgattccgtagaataataaaaattaattgttaatataaggaacaaaaatggatttcaatcgaattatcactcatatgaatgatcatcatcaagatgatatggctgtcctttgtaaaaaatttggcggcgaaaaggaaatcacagatgtgacgttagttaatgtagattttgctggtttagattttaaatataatggtggcaaaacattacgtgtggaatttccacaacaagctgacgcaggttcaattaaacaagtaatcatcaatctttgtgtagaaaataaaccagttgcaaattacgatcgtatcaaggctaaaattgatgaatttcgtcaagagtttaaaagctgtgtgctttctactttagataaagatggcttaccgatggcgtcttatgcaccaattattttctttgatggaaaatattatatttatatcagtgccattgcagagcattatgagaatttaaaacgcaatccaaatcaagtagaagtgatgtttttagaagatgaaaacaaagcgaagtcaattattgtgcgtactcgcttacgttataaagcaagtgcacgttttattcctcgtgaagatccaattgttgaaaaagtcttagataaattagccgaaactatgaatgatgtaggcggaattaaaacaattcgtgaatttactgattttgatttagttgaacttacatttggaacaggccgttttgtaagaggttttggccaagcttatttgattgatgctaatggggaaatttctcatattggtgtcaaaggcaatccacacgaaaaagaaagtgataaataatattgtctcttaatgaagataaagggttgagtgtaaatttatactcaccccttttgtttacgataagttcgagtgaaattgaaatttctttatttttttaccgcactttattttcattaaggacaaggcttgcttactataatttcgataacctgtctgtcgatatgctgcatactttttgatgcaatagaacagagattatcaatagttcgatcaagatcgtgttcgacaataccttcattgccgcagcaataggcaatccaaccatgccagttccaggcacagcaacgcccaatccatttttcatcagattaggcgaaacttttgcttcaatgcgttcaggtgttttgcctaaatatttcgcagctgtagcagatgcgagcgcaagagaaatgggttcggtacagcctagggctggcataacatcgtgtttaacgatgtggagtaatggtttttcaatttcgttaagtctttctaaattcattattacctatccaattaatgcgcttcatcccaattttgtccaacacctacttccacaatcaatgggacaactaattcagcagcggcttccatgtgttgtttaatttgctcacggaaaaacgcgactttttctgaccgcacttcaaacactaattcatcatgtacttgcataatcatttcaatatctggatcgtgacggattacttcatcaagtttaatcatcgctcgtttaataatatccgcagccgtgccttgcatcggtgcattgattgccacacgttctgctcctttacgacgcattgcattgctagaattaatatctggtaaatataaacggcgaccaaatagcgtttccacatagccttgtgctttcgctttttcacgaatatcagtcataaattgttgtacgctaggatagcgttggaaatataaatccatatatttttgtgcatcagcacgggaaataccaagttggcgtgaaagtccaaaggcggacattccataaattaagccgaaattaatcgctttagcattgcgacgttgctcgctggtgacttcatctaatgatacaccgaaaatttcagctgcggtggagcgatgaatatccttgccttgcgagaacgcattaattaagccttgatcgcctgaaagatgcgccataatgcgtaactcaatttgagaatagtcagcggcgacaatagaataaccttcacgcgcgataaatgcttgtcgaatatgacgaccttcttcattccgaattggaatattttgtaggtttggatcacttgatgataaacgccctgtcgccgtcaccgcttgatgataagaggtatgcactcggcctgtttgtgaattgaccatttgaggcagtttatccgtgtaagtggatttaagtttgctcaacccacgatgtttaaccaaaattttgggtaattcgtggctataggataattcttccaatacttcttcattcgttgatggcgcaccttttggcgttttttgtaaaacaggtagctcaagtttatcgaacaaaatttcttgtaattgtttggtggaggctaaattgaatggctgacccgctaatgcgtaagcttgtttttcaagtgcggttaatcttgaggcaatttcgttagattgcataaagagagcatcactatcaatcaaaacgcctgtacgttccatacgagaaagcacatgaagcaatggtaattccattgttttatacaattcaacaagcgttggttcttcttgcagtttcaaccacagtgcttgttgtaatttcattgtcacatcagcatcttctgccgcgtattctgtggcttgttctaatggaatttgattaaacgtaagctgacttttcccttttcctgcaaggctttcaaatgcgatagtttcatgacctaaataacgtttggctaaatcgtccatattatgacgacccgtactatttagcgtataggaaagcaacatcgtatcaaattcaacaccttgtaattcaatgccatgacgggcaaaaatactttcatcaaatttaatgttttgtccaattttgtgaatattaggattttctaagattggtttgatagcggcaagtgcggtcgatttttcgagtgtttttggtgcatccaaataatccaattgcaatggtaaataagcagcttcgccattttcaagagcaaaagagatacccactaaattcgcagacatataatcaaggctgtctgtttcagtatcgactgcaatgagttttgctgcattgagcttttcaatccagcgggttaaatccgcttgagtgagcaaggtttcatattttgtacgatcgatttgaattttaggcgtattttccaccgcactttgatcttgtgaggtcgctttatactggttcattttcactggctgttcagtggtttgggtaatagaatctgccccattcatcacttcattaagccagcgtttaaattcgtagcgagcaaaatattcaataagttgatccttttggctttctccaagcaacaattgatctgttgtcacgttaagttcaacatcggttttgatggttgctaatgtataagaaagatcggcattgtttttttctgccaataatttttcacctaattttttcgctccacgaattggcagttccgctactttttcaagattggcataaatttcagccatgcttcctatgccttgtagtaaaccaagtgcggttttttcgcccacgccagcaacgccaggaatgttatctgcactatcgcccatgagtgctagataatcaataatgagttcaggtggaataccgtatttttcaatcacgcccttgcgatctaataagctattattcatggtgttgatgagcataatattgtcatccaccaactgtgccatatctttatcgccagtactaatgagtacttttttacccaaacttgatgcttgtagtgcgagcgtgccgatcacatcatctgcctcaatcccttccaccactaaaagcggaatgcccaatgcacgaatcatatcgtgcaaaggctgaatttgtttgcgtaaatcatcaggcattggtggtcggtgagatttatattgttcaaacatttcatcacgaaatgttttcccttttgcatcaaaaacaacggctatatgagtgggctgtacttgtgagatgaggctttttaacatatttaacacgccgtacatcgcgcttgttggctcacctgcggcattagttaaagaaggaaaggcatgaaatgcacgatataaataagaagaaccatccactagcacaagcggatttgttgcaatttgggccataaaaatctcgttttaaactgaaaaatgtgggcattatagcgtaatttatggtgatgagcgaatggcgggtttaatgtaaaatttatgacgaatattttttgctatggcataatatcagccattcaaatatttaatttaaggaaatcaaatgtcgttaaaattggtcgaaattttagttttgggtcaggttttgcgtttaaatgtacccattgaacaagaagaattactgcgccaagctgcgcgtaatttagatatattggtttccgaaatgaaagaaaagacaggccttattcagcttgatcgtgtgctttctattgtggcactcaatttgagttttgaattaagccaagaaaaaaataaaacggctaaaattgaagaggtattgagaacgggtatccaacaattagatcattcattagaaaatattcgtgttacaaaagaaccgcattaaattaatgatcaaattagagtcattttgtcgttttataagcaactcgttaaatttgacaaataaatgctagtcaatactgagaatttgggctagtataaacccataagaattacctggagtgttcgtcagtaggctatgtccctgagccgatactttaaatcttataaattggtttcctatcgttggtgtgtaggcttaacctttgactcgttcattgggctaagaaacctgaaaacggtatcaactgatttccttgaaccgtcgggttcaaggactactgcccgcagcggcactctggggtcttccttttcatttctatgaatactcaaaaacgccagcaaatccgcactgaaatccgaaaaatacgtgcaaatttaaccgcacttcaacagcaccaagctgaacaatcggttactcaacacgcgttaaatcttatcgagcaacgacaagccaaaaatattgcattatatttttcttttgatggtgaaatttccacaaaagccttaatccaatccctgtggatgcaaaataaaaatgtgtatttgcctgttttacatccttttactaaacactatttattgtttttacgctatttacctgatacgccaatgaaacaaaatcagtttggcatttgggagccaaagctaaatgttcaaaatgttttgccattaaatgaactggatattttatttacgccattggtggcttttgataaaaaaggaaatcgccttggtatgggcggtggattttatgatcgcacgttgcagaattggcaaaataaatcttttattccagtggggttagcgtaccaatgtcagcaagtagaaaatcttcccactgagcattgggatgtgccactattcgatattttggtaggttgaaacctatcatcaaatttttattgatagataaaatcaaaatatttcattttttctcttgaaatttattcaaccgagcttacttagtttatgcaaatggcgaaagccgaaatcaaattgaggaaagtgtatgaacattgaaaaatttacgacaaaattccaagaagcgttaagcgaacgacaatcacttgctatcggaaaagacaatcaatttattgaacctgtgcatttattgaccgcacttttaaatcaacagggcggctctattgcgccaattttgacagcaagtggcgtaaatgtggctttattgcgtaatgaattaaagacagaactaaataaattgccgcaagtgattggcaatggcggtgatgtacaactttcacgccagcttattaatctacttaatttatgcgataaattcgcacagcaaaaccaagataaatttatttcgagcgaattgtttttgtttgcagctttagaagaacgaggaacgatcagcgatattttgaaaaagtgcggtgcgaaaaaagaacaaatttcgcaagctattcagcacattagagggggacaaaacgtgaacgatcaaaatgcagaagaaagcagacaagcgcttgaaaaatatacgattgatttaaccgctcgtgcagaaagtggcaaacttgatcctgtaattgggcgtgatgaagaaattcgtcgagccattcaagtattacaacgtcgtaccaaaaataaccctgtgttaattggtgaaccaggtgtagggaaaacggcgattgtcgaaggcttggcacagcgcatcgtaaacggcgaagtgccagaaggtttgaaaaataaacgtgtgctttcattagatatgggggcgttgattgctggtgcgaaatatcgtggtgaatttgaagaacgtttaaaagcagtactcaatgaactttcgaaagaagaaggtcgcgttatcctctttattgacgaaattcatactatggtcggcgcgggtaaaaccgatggtgcgatggatgcgggtaatttgttaaaaccaagtttggcacgaggcgaattacattgcgtgggtgcaactactttagatgaatatcgtcaatatatcgaaaaagatgccgcacttgaacgccgtttccaaaaagtctttgtggacgaaccaagtgtagaagataccattgcgatcttacgtggtttgaaagaacgttatgaaattcatcatcacgtggatattactgacccagcaattgtcgctgcagcaacgctttcacatcgttatatttccgatcgtcagttaccagataaagccattgatttgatcgatgaagcagcgtctagcattcgtatggaaatagattctaaacctgaaccgcttgatcgtcttgaacgtcgtattatccaattaaaattggaacaacaagcgttacaaaaagaagaagacgaagcaagtcgcaaacgtttagaaatgttagagaaagaattggctgaaaaagaacgtgaatacgccgaacttgaagaagtatggaaatctgaaaaagcaacgctttctggctctcaacatattaaacaagagttagatactgcaaaaaccgaactagaacaagctcgtcgcgcgggtgatttagcgaaaatgtctgagttgcaatatggccgcatccctgatcttgaaaagcaacttgagcaagctgaaaccagcgaaggaaaagaaatgacgcttttacgctatcgcgtcacagatgaagaaatcgcagaagtgctttctaaagccacaggcattcctgtatcaaaaatgatggaaggcgagaaagaaaaactcttgcgtatggaagatgaactacataaacgagtgattggtcaagaagaagcggttgatgcggtagcaaacgcgattcgtcgtagtcgtgcaggtctttccgatcctaatcgcccaattggttctttcttgttcctagggccaacaggtgttgggaaaacagagctttgcaaaactttggctaaattcttgtttgatagtgaagatgcgatggtgcgtattgatatgtcagagtttatggaaaaacacagtgtttctcgtttagttggtgcgcctccaggctatgtcggctatgaagaaggcggttatttaactgaagctgttcgtcgtcgtccatattcagtgatcttattagatgaagttgaaaaagcacacgcagatgtattcaatatcttattacaagtgttggatgatggtcgtttaactgatggtcaaggtcgtactgtggacttccgtaacactgtggttattatgacctctaacttgggttctgatttaatccaaggtaataaagacgaaagctatagcgaaatgaaagccttagtgatgtcagtggtaagccaacatttccgcccagaattcatcaaccgtattgacgaaaccgtggtattccatccacttggtaaagaaaatatccgtgcgattgcaagtatccaattagaacgcttagcaaaacgtatggaaactcgtggatacgaattggtgtttaccgatgctttattagacttcattggcgaagtgggatacgacccaatttatggtgcacgtccattgaaacgtgctattcaacaagaaattgaaaacagcttggcacaacaaattctatctggtgcgttattacctggtaaggttgttaccattgattatgccaacgcagaagttcaagcgagacaataggtattaaaaaagtgcggtaaatttaccgcacttttcttatgaacctaaacgctgacgtacaatttcaaataaacatacccctgttgcgacagatacatttaatgatgaaactgaaccagccattggaatgctaatcagttgatcgcaatgttcacgtgttaaacgacgcattccttcgccttcggctcccataacaagtgctagtggtcctgtcagtttgctttgataaatggtttcagttgcttcgccagcagtgccaaccacccaaatattatggttttgctgtaaatcgcgtagtgtgcgagaaagattggttacacgaattaacggcacggtttctgccgcgccacaagcaactttacgtgcaatagatgttaattgtgcggatttatctttcggtacgatcactgccactgcgcccgctgcatccgctgttcgcaaacatgctcccaaattgtgtggatctgtgacgccatccaaaactaataaaagcggattttgtttattcgcaagaatttcatcaagatcattttcattaagttcttttgccgcttgtactcgagcaatgacaccttgatgaacctcaccatcggcttttttatcaagtgtttgtcgattaacaaattgcacaccaattcccagggaataaagctcatttaagagtggctgtagacgtttatcttcacggcctttaagtacgaagacttcaattaaacgttctggtgaatgggttaaaatactattaacagcatgaatgccgtagatttgttctgacataaatttctctttttcttatttgaatttttaattcattcttacaataggaagtgaattattttcgttttctagatgttttcttcgaaacgtctttcttttttaccgcactttttcgttttttggaggctttggacggtagctctttaaaaactttcttagctttttctttcgcggtttttccagctcgacgaggcttacgttcactacctattagcgagaaatcgaccattttattttctaaatgtaccgcttcaactttgatgcgaactttatcgcctaagcgatattgcattccgctattttcgccgattaaacgctgttttgctgcatcgaattggtaataatcgttttctaaggtggaaatatggactaaaccatcgatgaataaatcatctaagcgtacaaataaaccaaatcccgtcacagatgaaataacaccgctaaattcgccaccgacatgatcttgcatatattcacatttcagccaatcagccacttcacgagttgcgtcgtcagcgcggcgttcggtcattgaacagtgattgccaagtaaatccatttcatcaaaagagtaatgataaccgcctgtatcggtggttttacgtttagcgccttgttctttagcgagtaaatatttgatacctcgatgaagtgttaagtctggataacggcgaattggcgaagtaaagtgagcatattcttccaaagccaagccaaagtgcccaatattatcagcatgatagacggcttgacttaatgaacgtagcaacattgtttgaataagttcatgatcaggccgttctttaactttttctaagagagcagcatagtcttttgtagttggttttaatccgccttctaaagttaaaccaaactcacttaagaaagtncggaacgatgttaatttttcttcgctcggggtggcatgaatgcgatataacgctggctctttatgtttttccataaaattggctgctgcgatattcgcaagawtcatacattcctcaatgattttktgggcatcattgcgaacaacgggttcaatacgctcaattctccccattgcattaaaaataaacttagtttcaatggtttcaaaatcgatcgcaccacgttgatgacgcgcactaagcaaagcttgatagagtttataaagttcttctaaatgaggcacaagcgtagaataacgagtgcgtaattcttcatcgccttcaagcatttttgctactttggtataagtgaggcgagcgtgagaattcatcactgcttcataaaagcgataatctgtgagcttacctttggcagaaatttgcatttcacacaccatacacaaacgatccacttgtgggttaagagagcataagccgttcgataaaatttcgggtagcataggtacaactcggttcggaaaatagaccgagttaccacgattatgcgcttctacatccaaagtggaacgtaaacgtacgtaataactaacatccgcaatcgccacccaaagtttccagcctttgccgtgtttttcacaataaacggcatcatcaaaatcccgcgcatcttcgccatcaatggtcacaagcggtaaattgcgtaaatccacacggcctttttttgcttcttcagagacttcttcagtgaattttttaacatatttttccaccgcacttggaaacttatggagaatatcgtggttacgcaaggcgatttctacttccattcctttcgccatattatcgcctaggatttcagtgattacgccaattggctggttaaaactggcagaacgttcttgcaattcgacaacgacaacttgtcccatacgtgcaccattacgatgttcatttggcacgagaatatctcgaccaattctgctatcatcaggcaccacatagccaaaaccgttttctaagaaaaaacgacccacaatttgttttttacggctttctaatacgcgcacaattcgcacttcacggcgaccacgacgatctaatccagcaggttgcgctaagacaaaatctccatgcatgactctttgcatttgatggttcggaatgaataaatcatcctttttgccatcgacctgtaaaaaaccaaaaccttcgcgatgaccaattaccgtgcctttaaataaatctaatttttctggtaaggcatagcgtttacgtttggtgaacactaattgtccgtcattttccatcgcgcgtaatcggcgacgcatcgcttctatttgatcttcatttcgaatggaaagtgcggtcaaaatttcatcccgattcatcggtgcattattgtctcgaataacggttaaaataaattcacggctcgggattggattgccgtatttttccaattctcgtttgtaatgcggatcttggtttattaagtttttacgtttttttgtcattattttttacagttttaaaaagtgcggagagtttgacactgtaaggaggataatgcaagacggggataaaattatcactgtatattttaaggatattttaaaattgaagaacttaacgatctttccccagcactataacagtgatgactttttatagatatttttaaagtatgaaaagcgcggtaaaaattttatgcaggaacgcgttctgttacgagcatttgtagttttcgtaaaataacatttaatactacgccataggctgggacgaacaagataattcctataaataatttaaatagataatctacaaagccgagttgtgcccagtgttcagccatgaacggatctgcactttggtagaaggcgatactgaagaaaacaaacgtatccgccattgaaccgaatgtcattgagctagttggcgccacccaccatgtttttaactggcgtaagcggttaaatacgatcacatcaagcaattgtcctacaacgtaagctgcaaaacttgcaatagcaatacggaatacaaacagatcaaaatgcgttaatgattcgaaaccttggaatttgctttcagagaataaaacagatatgacgtaacttacaataagtgcaggaaacatcactacgaagatgatttttctcgcatcttccgcaccgaaaattcgtacggttaaatcagtagctaaaaagataaatgggaatgtgagcgttccccaagtgctgtggaaagraaaatcatttgctgcaccaagtgcggtcaattttagcgtgatttcaaaagggatttgtacaaagtaattgctcgctgcaatgatgaatatgtggaaaaagctgagccagatgattgcacgacgtttttgttgatcattaaagatcggagaggttaatttcatgttgtacctttttagtttaaataaatcggggttagggaacccgaggttgaatatagggggctagatgatacgcatatttctaataattgcaagagtcgattgcatttgagttttatattttatgaaaattgacgaatgattttacagcctttattctatttgcgtttttcatcaaatttgaaaggagagaaaatggagttacacaatattcgtgatgaatatactaaacgagtgctttcacaacatgattgccatgaaaatccaatttcgcaatttgaacagtggcagaaagaggctattcatgctcaagtcaatgagccaaccgcaatgaatattgcgactgttgatgaacaaggtcgcccaaatagccgaatggttttgttaaaagaagtcaatgagcaaggttttgtcttttttaccaattatcttagtcgaaaaggcggctgtattgagcacaatccttatgtcgcgctgactttcttttggcctgaattggaacgccaagtgcggattgaaggtaaggcggttaaaattccagcagaacaatccgataaatattttgctacccgaccttacaccagtcgtataggagcttgggcaagtgagcaaagtgcagtgatttctaattataaatctttgttagcaaaagccgcattggttgccgctaaacatccgttaaacgtgccgcgcccagattattggggcggctatttagtcgtgccagaaaccgtggaattttggcaggggcgtccaagccgtttacatgatcgcattcgttatcgtaaagaaagtgataattggattagagaaagactttctccttagtaaattgagaatgaaaataaccgcactttagttgtatcccgaaagtgcggttaattttttctaaattttagcgtttagctttatttattaatgcgtgctagtacttgttgttgtacgatttgcacgtttgcgatcgttttccgttaaaagttttttacggatacgaatcgactcaggtgttacttccactagttcatcatcatcgataaattcaatcgcttgttcaagactgaattttacaggtgtagttagcacaatcgcatcgtctttacctgacgcacgcatattagttagttttttaccttgcaagcagtttacggttaagtcatttgagcggctatgaataccgataatttgaccttcataaacttctatgtttgcatcaatcattaacttaccacgttcttgtaagccaaataatgcatagccaagtgctttacctgttgcattagaaatcaacacaccatttttgcgctgaccaatttcgccgcctttgatttcatcatagtggctaaagcttgagtaaagtaagcctgtaccagaagtcatggtcataaaatcaccacggaagccaatcaatccacgactagggataatgtattccaaacgcacacgacctttaccgtcaggcaacatatcacgaacttcacctttacggatacccaatgcttccatcacagaaccttgatgttgttcttccacatcgatagttacttgttcgtatggttcttgttttttaccgtcaatatcacgataaattacttttggacgagaaaccgcaagctcataaccttcacgacgcatattttcgattaacacggaaagatgtaattcgccacgaccagatacacggaattcatctgggtttggggtttcttctacgcgtaatgccacgttgtgaaccaattctttatttaagcgttcaagaatttgacgcgatgtgacgtatttaccttcttgtcccgcaaatggagaggtatttacacagaagaacatggttacggttggttcatcaaccgttaatgatggcagtgcttcaactgtgttgatatcacaaatcgtatcagaaatatttaattctcctaaaccagtgatagcaacaatatcgccagcataagcaacgtcttcttcataacgttgtaaaccaagatgtccaagtacttgaccgatacgaccttgacgagtttttccttcactattgatgatagtaacaggttggtttggtttaatcgaaccgcgcttaatacgaccaataccaataacgcctacatagttgttgtagtctaattgtgaaatttgcatttggaatggcgcatcaagttctacttttggcggttctacatgtttcacaatggcttcaaataatggggtcatatcttccgctaaatcttcgtgttcaagaccagcaacaccatttaatgctgaagcatagataatagggaagtctaattgttcatcgcttgcaccaagattgacaaataagtcaaacacttgatccacaacccagtcaggacgtgcaccagggcgatcaactttattaattacgacgattggttttaagccgtgagcgaatgctttttgtgtaacgaaacgcgtttgtggcattgggccatcaaacgcatcaacaactaatagaacagaatccaccatagaaagtacacgttcaacttcgccaccgaagtctgcgtgccctggagtatccacgatgttaatgcggtagtcattccagttaatcgcggtattttttgcaagaatggtaatgccacgttctttttcaagatcgtttgagtccataacgcgttcatccacatcaccacgagcagattcaaaagtaccagattgttgaagaagtttatctacaagagtggttttaccatggtctacgtgcgcaataatggcgatgttacggagttttttaatatcaatttcgtttttcattgtttaatgctttaattggataagatgcaatttttattgcattgttacataaaaaatggcgcaatgaattgcaccctacatttctacatttgtcgaaaaggaaaaattatacatgtatttttctttttctgctatgactagaataagaaaaataaatttcatgaaaaaatagcatggctacgttataatgtgcgcttatcttaataagactaaccatagaggatttcctaatgccaaacgcaaatgcaattgccaatgtatttaagctaattgaagaaaataatgtgaaatttgtacttcttcgatttaccgatattaaaggtaaagaacatggtgtttctatcccagttagccttgttgatgaagatatgtttgaagacggcaagatgtttgatggttcctctgttgaaggatggaaaaccattaataaagccgatatgttgcttatgccaatggctgaaacggcaattgttgatccattcgcgcaaattccaacgctttctattcgttgtagtgtttatgaaccaacgacaatgcaaagctatgatcgcgatccgcgctctattgcaattcgtgcagaaaattatatgcgttcaacaggtattgctgatcaagctttttttggtccagagcctgaattcttcttatttgatgatgtgcgttttaatgtatcaatgaacaaagcatctttttctattgatgatatagaagctgcttggaacacgaataaaaaatatgaagaaggcaataacgcttatcgcccattgaaaaaaggtggatattgtgccgttgcaccgattgatagtgcgcacgatattcgttctgaaatgtgcttgattttagaagaaatgggattagtcattgaagcccatcatcatgaagtggcgactgcagggcaaaacgaaattgcgactaaatttaatacgctaactttaaaagcggatgaaactcaaatttataaacatgtcgtacaaaacgttgcattagagcacggtaaaacggcgtgttttatgcccaaaccaattactggagataatggttcgggtatgcactgtaatatgtcgttaagtaaagacggaaaaaatattttccaaggcgataaatatgcaggcctttctgaaaccgcactttactacatcggcggtatcattaagcacgctaaagccttaaatgcgttcactaatccaagtactaattcatataaacgtttagtgcctggttatgaagcaccagtattgttggcttactctgcaagcaatcgttcagcctcaattcgtatccctgctgtaaccaatccaaaagcgattcgcgtagaagcacgtttcccagatccattggcaaacccatatttagcatttgctgcattattaatggcaggtcttgatggcgtggtaaacaaaatccacccaggcgatgcgatggataaaaatctttacgatcttcctccagaagaattaaaagatattcctgcagtagcaagctcgttagaagaagcgttaaattcattagaaaaagactatgaattcttaactcaaggtggcgtatttgctaaagattttattgatgcgtttatcagtatcaaacgtaaagaagtggaacgtttaaatatggcaccacatccagttgaatttgaaatgtattatgcataatgatatataaacaagaacaatgcggtgaaatttcgccgtatttttttaaaggagtaaatatgactaagatttcttctcaaaagaatgactagattgatttaatggagcttttctgcgtattcatagcaatagctggcgtataggcctgtacggcaaaagagcagtggacttcaactgatattgggttgtgcctcgttcaaccgatttcggtaacttactgcctacacgtgtggaatatgccacattattggcgacagtgaattttcttctgtagcgttatcaggttcattgtatggtcaatttaggcacttccttctttctagagatttaaaacgccagttcttaaaacaatctgtatgggtgaaaattatactaaggagatgacagaagaataaagacatatttatattgaaaatgtagtctctaagtatttagttgttcacgaaattgatccgaagaaaaaagatttaactgagttggataaaatagctttaaaaattaccttttcagcagaaactccaaaatatgcacaatctgtattgacagagtatgtaaattttgtaagtcaatatagtcttaaccaaacaaaccaagagtttaaacagggatttaacctccgtttagatgagctgagatttagtaaagaacaaattgaagagaatctaacagaagaaaaaaaggttcaagttgaaaacttaacaaatgcgttagatattgctaaaaaagcgggtattaaagatttttcaagaggaaataatatctctgattctaaattagcagatggtacatatttatttatactcgctgaaaaatatttacaggcgcaactagatattgctaaaaacacacctgttgtttacccagctaattattatattacagatagacagttatttaaattaaataaattagcttcacaattggaattagttgaggatgtaaaaacgtattattatttaagctctcctgattatcctgtggttaaagataatcctaagagatcgttgattcttgctatcgggtttattatcggtattctgttacctactttctttattttattaggttcggttatacaaactaataaaaagcagtcatgaagaaaaaggctatttttatcagtacgggagcggttattatctttaaaatattaactccctgttatagctggtgtactagcaaaatttatgatgctttccgaaaatgtttgcctgcaatggataatccatattttcaagagagctgatctgaaaaggattatgaactgattaaggcgttcttagctggtgagaataaaaggaaaactaaatgcttttatgatctgtaaggaataaagaatgagcttaattaaagatagttctatttatttaatcggagagttatctgcaaaatgtgtaccttttctattactaccctatttatcgcgtaaattaggggtagaaggatttggggagctttcttactatcaaacgtttttacctttatttgtaatttttattgggctaagccaagatggcgctgttgctcgctatttttatgtgtatggtaaacgctcattaaatttagttgtgaagacaggctatgcctatacgcttagtattggtggattaggtttgcttttttgctggttaatgcaatctgaaataatgttttacttagtattaagtgcgatatttcaggtgtttctttcagttcagctcagcattagacaatgtcaaaaacaagcgattccctatacttttattcaagtttcttcaacgattacaaatgcagcacttactatattaatgcttgaattctatcaaacagatttggtagaaaaacgtattttagcaattttaataagtaatgtttttgtagctttactttcttatttaatctatagaaaaagagtaaataataaaaagttttattttttacaatataaaacagcttttttctatataatgtcttttggttttctgatgatttttcatcacggtagcttttttattaggcaattggatagaatctttatttttcatcgctttagcgaagcggaattaggtttatatgcaatgggagcgcaaattgcatttatcttatcagtttttattttagcgataaataaagcgcttgttccctatctgtttgagaaattaaaacaaggtagtgttaagttaaaagatttacatagatggtcgttactttcattattgattgtgcctattccatcacttgttaccttaattgttccggaacaatggctattgttcttcttaggcaaacattttatcggggtaaaatactacattatagtattcttactctctacgagtttaaccatcccttatttgttcttagtaaattatttgttttatcacggaaaaactaaagaaatttcgttttgctctgtattatcaacaatgatttacttgggagcattggggggattaatttttacggatgtggtttatattccttatgctagtgtattgggggcattggggattttacctgtattatataaaataacaaaaagagtagaagaaaatgaatatgccactcattagtataataatgcctgtttataatgcagaatgttaccttaatcaaggtattttatcttgcttaaatcaatcttatcaaaacattgaattaattttaattgatgatggttcaacagataaaagtattgaaataataaataacatcattgataaagataagcgggttaaacttttctttaccccaactaatcaagggcctgcagcggcaagaaatatagggttagaaaaagcacaaggtgactatattacattcttagatagtgatgattttattgcaaatgataaattagaaaaacaacttaattttatgttgcaaaatcatcttgtaatgacgcatggcaactatgctttctgtgatttggaaggaaatcagataaaattagttacgactagtaaaaaaattgattatttaaccttattacaaggtaaccaatttaaaataatgactgtacttgttgaaagagaatctattaaattacttaggtttcctaatattaaacacgaagattacgccttctttttggattgtttaaaagaagttaaacaatctatactatatagccatcaggcaagttcatttgtaagaatcggtaaagtcagcgtttcatcaaataaatttaaaagtgcaatctggacatttaatatctattttaaaagagagaaactaggtgtagtaaaatcaatttattattttatcctctatgcctataatggatttattaaatacaagaaataaaaatatgatttcattacttattattagcttcgggcgttatcaagaagtattggaaacgtttgcatgtgtcaataaatatcatggcaataaaattgaattacttttccttgataataatccagaaagagagttggaagcggatctatcttctattgtagaaaataatagtggcattttatttagctattttcatacaggtgagaatctaggtgttgctgaaggacgcaatttcttaattgaaaaagctcaaggcgatattttaattacacttgatgacgatgttgaaattgaagatattactcttttaattcagaaagtgactgattatatggcaaataatgctaaagtaggagcattagcctttaatattaaaaactattttactcgtaaagcattatcacacgagatcccacatggtaataaaaagttagatttttcacagaatttactgacttattattttattggtgctgggcatgcaataagggaaaaaagtctatcaaaaagcggggctttaccctaaggatctggggctatatggtggcgaagaaagagatttgtcatttaggattttagaatcaggttatcagatactttatgctagtgatattgtgacttaccataaggtttcaccagatggaagaatgagtaaagaaaaagaaaacttctttcgctatcgtaatcaattgatcgttttaaatcgttatatgcactagaatctatcgctatagtgcaaatttgatttggtctctattctatttgattaaaaaaagtggaaccttgaaagaggtaatagaagtttttcattatttatctttattgtctaaatgcacaatatcgagaagaactttattatatataaagaatgttaatggtagattgttttattaaatttatatggttatatatttgcttctattatttttacttatatttagtagtgccattgatgcttttggaacatcaaggaaaaataagtattttttcttttttataagttttatgccctttttctttgttgtttctcttagagatggaattggagtagattattaccaatactaggagctttttaatttatccaggccaatatatgatgttaatataggtgctttaactaaagaacccaataatatttaattgagatatctactatttgaatcgttggttaagtatttatctaatagctttaatgtttttttatttttatatgatattgttttattctattttctatatcttggaattagaagatatccatttaagtctttttagttattaatattttttgctctttttcatatttattatattagtggacacagacaggctatggcaatggttatttatcttatcttatcttatcttatcttatcttatcttatcttatcttatcttatcttatctttttcattgttctagtgctttatatctgcttccttgcttattactttcttttttgattttaagataagggatattttgattttatctctcttatccgctattttagtatattatgattttttcgggtgggtatagagtatttgtatgaaaattactctaatgttagctatatatttggtagggtttattattattttgtccaatattctggagggaaaattaataccttaaactatataaaggttttctctatatatgtaatggttttatacttttataataagattaatagaagttttgggttgatgattttattatatttttttaggagtggtggtcttgccttcaggatctctgagttgtttcttatattttctattccgctttttgctttgttaattaatgaactatctggagtaaatagagttttaatgttttttattttagtgtattatatttctatagttttcttgagaagaatatatgttcatgtggtgtttggtgtaaatacatttttaccttataaaccaatattcgatagttatctataaaaaggttttaaatgaaatttgtttctataattagtaattctaggatgttatttttatttttgttaataaccgccaagtctgatagagagagttgtttgtatatatttgacgaaaatattcgaggtgttaatataactcctacatttgtttctacaagagctaaggggttatttgatctttttataaaaaaacttagaagtagggtagctttatctttctttttactaaaaagaaaaataaagttggaagagactatagtttatggtgcagatcatttgtctcattcattgttatttctgaagaagtgttctttctttttaatagaagatggtacagaaaattaccaccaaaaaagttataagagaagttggaaaaataaactattttcaataccaaaatttggaatgtataaaaatgtaaaaaggatctatcttacaaagagagagaatgttcctgattgtataaaaagtaaagtagaatacataaatatcaaagatctttggtttaaaaagacagaagaggaaaaattagaaatcttatatctattggggatagatatgaaaaaaattcagctattgattggcgagccttttattttatttactcaacctttatctgaagattatattcttacagaaaatgaaaaanttgatttatataaaagcnttattgataagtatgatgcatcaaanttggtgataaagcctcanccaagagagangacggattattctaganttttnccaaatgttaaggtgtttgatgaaacctacccttcggaagtattggatattttggaagtgaaatttagtagagtaattactcttttttctacagcagctttttcttaccccaaagagaaagtcgatttttatggaaccaaaatacaccctaagttattagcaaagtttggaaatattgagtatgaatagattatttttttctaaaattgcgttatggttattggattttttaacatttaatatttcttttttattatccttatttgttatttcttattatcataatggttatgaaaaatatttacctatttatgaaattgatgacagaacatatattcatgctgttttagctggaatatgtgttggatggtttgctattaggctaagacattatacttatagaaaacctttttggtttgagttaaaagagatttttagaacacttattatctttgcgatttttgaacttgcaattgttgcatttcctaaattgtatttctctcgctacttatgggcgcttacatgggggattacctttctactttttccattggcgagagttttagtaaagaaatttcttataaaatcaggttggtttcttagagatacaattatgattggttctggggataatgcttttgatgtttataatgcattaagagatgaaccttatttggggtttcaggtcacgcattttatttcagtttctaatattagtaataatgtaaaggaattaaatattcctatattaaatagtatgtcttcttggacatcagtaactaaaaaaacagatcaatttattattgcattggaagatgatgaagaggtagatagaaataattggttacgttattttnccacaaatggctatcgttcagtttctgtgattcctacattgagaggcttacctttatataatacggacatgtcttttatgtttagccatgaaatcatgttattacaaatgaataataatctggctaaactatcttctcgtattttgaaacgaaccatggatattgttgttggctccttagctattattatattttccccagtgttgctttatctgtattttgcagtaaaaaaagatggtggtaatgctatttatgggcatcctagaattggtcgtaatggaaaaacatttaactgtttgaaatttagaacaatggctgtgaattctaaagaagtgctagatgaattgctaagaacagatcctgaagcaagagctgaatgggaaaaagattttaaattaaagaatgatcctagaattactaaaatcggtgcttttattcgcaaaacaagtttagatgaattacctcaattatttaatgttttaaaaggtgaaatgagtttagttgggcctcgcccaattgtaattgatgagctagagcgttatgaagaaaacgtagattattacttaatggcaagacccggtatgacagggctttggcaagtcagcggacgtaataatatcgattataatactcgcgtttattttgattcttggtatgtaaaaaattggtcactttggaatgatattgcgattttatttaaaacaatgaatgtggttttaaatcgtgatggagcttattaacgttatttcttaagtgagatttcttctatttgcattaccttaaatttattaacccaacatgatgaatattttagtcactggcggttctggcttcatcggttccgctcttattcgatatatcattaatcatactcaagatttcgttatcaatattgataagctgacctatgcagcaaatcaatcagccttgagagaggtagaaaataatcctcgttatgtctttgaaaaagttgatatctgtgatcttaacgtaatagaaaacattttcgaaaaatatcagcctgatgcggtgatgcatttggcggcagaaagtcatgtcgatcgttctatttcaggagcggctgattttgttcaaacgaatattgttggtacttatacgttattagaggtcgctaagaattattggcatactttagacgaggctaaaaaaacgacctttcgatttcaccatatttctacagatgaagtgtatggggatttatccctttctgagcctgcctttaccgaacagtctccttatcatcctagcagcccttattcagcctcaaaagccgcaagtaatcatctagtacaggcttggcatcgcacttatggtttaccagtgattatcacaaacagttcaaataactatggggcttatcagcatgctgaaaagctcatccctttaatgatttcaaatgctgtgatgggaaagcctttgccaatttatggtgatgggcagcagattcgtgattggttatttgtggaagatcatgttcaagcttcatatttagttttgacaaaaggtcgagtcggagaaaactataatattggtggaaattgtgaaaaaacaaaccttgaagtggttaaaagaatttgccaattactcgaagaacttgcgccaagtaagcctaatcacattaagtattacgaagatttaatgacttttgtaaaagaccgacctgggcatgatgtgcgatattcattggattgttctaaaattcatgcagaattaggttggcaaccgcaaataacctttgaacaaggacttcgtcagacggtaaaatggtatttgtttaatagttcatcttcttaaatagggtaaacgataagaatgtttatctatcttgtaattttttctctttttattagacaataaaacacaacatagctgaaaaataaaaaatattgcctgagttatgagccaagaatgactggcttgtgaaataaaatatatgggaaacaatatgtataattcctaaaatacaaatacattttgtttctaaattatgggtgtttaaatttttaataaagnaaaatattggagttagaataatcaggattaatgctataaatccaactaaaccacgtttcacccaagattctaaatattgattatgtaaacttccaaaatttaaagtggttttagccatttgtttagattttacttgtttatgtctaaactcatcgtatccatcactcccatggccaaagataggcgcttcctttatagcaattaaggcattttcccacatgtcaaatctggcacctaatgaggtatttctattgtttttttctaaatagctaacaatatctgattttgctgcgttatatcgtttttcaattccgaatttaggactggtaattagtgcggttaatccaatggtaataatggcgattaaagttataataagtttcttattaatgaattctttgtatagaaataaaattataccaactacaacgggtaagccaatccatccacctctagccccagataatgcactagtcatgatagcaagtataatggctacaaacccaaataatgtagatttatattgttttttgatgaagaagtgaagagtgataacaatgctgaatgtggctaaagagatcgcaatgttgcccatttgtatatgcattgtttcaggaaacggtttttcatatcctaatgcaaatttctgaaataacgcaacacatcctgtaattaatgcactagaaggaattgcgtataaaattgttttcctttttattggaaaatttttgaataaaagtagtagaggaatgaataaaagaagtcggcttggattatctatttctctaattccatctttattgataatgatagataataagaatgtgaaaaaataaaataaaaaagaaaaaatcagttttttatcttcagagctaaaagatagttttttctttaatggtatgaaataaatcaatccaattgcgcttaatattattggcgcatagttataaccctttggaatgattaaaatggttaagaaaaatagagaaactaagaggttaattgtaaacgttagatgttttnnttgaatcatacgaataaaagcatgtgtaacttaaatttagtagattctaccttaaatatttgtaaaatgcttgttattcatgatggaatgatgtgaaattaggcataaaactggtatagtttctaaatttattttgtttatatatgggggaataaatatgcaaattacactttcaaataccttagcgaatgatgcttggggaaaaaatgcgattttgagctttgactctaataaagctatgattcatttaaaaaataatggaaaaactgaccgcactttagttcaacaagctgctcgtaaattgcgtgggcaaggaatcaaagaggtggagttggtcggcgagaaatgggatttggaattttgctgggcgttttatcaaggtttttataccgcaaaacaagattacgcgattgagtttccacatttagatgatgaaccgcaagatgaattgttagcacgtattgaatgtggcgattttgtgcgtggaattattaatgaaccagcacaaagtttaacgcctgtgaaattagtagagcgagcggctgaatttatcttaaaccaagcggacatttataatgaaaaaagtgcggtaagttttaagattatttctggcgaggaacttgagcaacaaggttatcacggaatttggactgtgggtaaaggctctgcgaacttgccagccatgttgcaacttgatttcaatccaacacaggattcgaatgcgcccgtgttagcttgtttagttggtaaggggattacttttgatagtggcggctatagtatcaaaccaagtgatggtatgagtacaatgcgaactgatatgggcggggctgcattattaacgggggctttaggtttcgctatcgctcgtggattaaatcaacgcgttaagctgtatttatgttgcgcagaaaatttggtaagcaataatgcctttaagctaggcgatattattacttataaaaatggcgtgagcgcagaagtactgaatactgatgcggaaggtcgtttggtgttagctgatggattgattgaggctgataaccaaaatccaggttttattattgattgcgcgactttaactggcgcanaaaaagtggctgtaggaaacgactatcattctgtattatctatggatgatgaacttgtgaaaaatctttyccaatccgcacaagcagaaaatgaacctttctggcgtttaccatttgaagattttcatcgttcacaaattaattcatcttttgccgatattgctaatattggttcggttccagttggagctggggcaagcactgcaacggcatttttatcgtattttgtaaaaaattataaacaaaattggttgcatattgattgctccgcgacttatcgtaaatctggtagtgatttatggtctgttggggcaacaggaattggtgtgcaaactttagctaatttaatgttatcaagatcattgaagtaaggagatgtgatgacagaaagaactttttcgattattaaacctgatgtagtaaagcgtaatctaattggggcgatcttaactcgttttgagcaaaatggctttaaaatcatagcctctaaaatggtacgcttaactcgtgagcaggctgaaggcttttatgcagagcatcaaggcaaagaattttttgtgcctttagttgaatatatgatgtcttcaccgatagtggtttctgttcttgaaaaagaaaatgcagtgaaagattaccgcactttgattggtacaacgaatccagaaactgcagcagaaggtacaattcgtaaagattttgcattaagtcagcgtgaaaactcagttcacggatcagatagtatagaaagtgcaaatcgtgaaattgcttatttctttactaattctgaaatttttgagcgttaattaatagcaaaaagcacctaaaaattttaggtgcttttaaatttttaatgcttacaaaattagactttcttaaggtttatagatgaactcaattccttcatcgtcttcttcgctccaatcatcatcccaatcttcgtcatcatcaaattgatgctctgctagtcgttcttgatgataatcttcccatttgaattttacttcttcaggtgcaacttgttgtgtttcagcttcgcgaggatttgcgatgataaagtccataatatcacgacaaagtggagaaacatttttccctgttgccgctgaaatgaagtaataatcttcttcccaacctaattgttcagcaatttctctggctcgctcttcagcttcttcatcgctcatcgtatcaattttattgaatactaaccaacgtggcttttctgataatttttcactgtattggaaaagttcagattcaataatagccatattatctgctggattagagccatcaattggcgcaatatcgactaaatgaataagcactctacaacgttctagatgttttaaaaaacgaattcctaacccagcaccatctgctgcgccctcaattaatccgggaatatcagcgactacgaaactgtgtgagtcatccacttttacaacaccgagacttggtactaaggtagtaaatggataatctgcaacttttggtttggctgctgaaacggcacgaataaaagtggatttaccagcattaggtaaaccgagcattcccacatcagcaagtagcattaattccaataataaatcgcgtttttcgcccggcgtacccattgttttttgacgcggtgcacggtttactgatgatttgaaacgagtattccctaaaccgtgataaccacctttggctaccaacattttttgaccatgttgggttaaatcccccaaggtttctttggtgtcgttatcaatagcacgagttcccacgggaacaggtaaaataatatctttaccgcgacgtcctgtacaatctgaactccgtccattctctccacgctctgcggcaaagcgtttattaaagcgataatcgattaaggtattgaggttttcatcggcttgtaaatagacatcgccaccatcgccaccgtcgccaccatcagggccgcctttcggaataaatttctctcgacggaaacttacgcaaccgttaccaccatccccagcctcaattcgaataagggattcatcaataaatttcattaaaacttctccaaaataaaccgcactttaatgatttttatgcggtaataatttatgtccaattgcggataaaattgctccgcatactacaacaaatgcgccaatatagctaatattattcaattccggtgccgcaaaatctgctgggctaaaataatgcgcaatatgagaaaataggatcgtgaaaagaggtacaagtgtgataacaacactgacttttgatacatcccaacgattaagtgcttccgcataagagccgtatccaattaaggtatttaaacagcagtaaataaaacaaatcagagctaaaggtgtgagttcttgtacttgcgagaagtcagccatcggcataaaggctatggcacaacctaaatacatcattagcaagatttgttgtgaattaaatttacgtaacattaatttttgcgccattccataagcgacccaaataagagcaccccctacacctaaaatgacacctgttgaatactgatttagtccaggcaaatgcatcaaaacgatcattaaagnataagcctaaaccaattaataataagaaaagtccgatcttttggtgcaaccctaatttttctttgaaaatcagtacaccacagatgagcattccaaaagaggataaatgaataaaaatttgtgcaactgacggttcaatgtaattcagcgagctactaaataatagaaaattgctggtaagaccaattactccaataagcataatccacgcatattggcggactttcattaattcaggtaattgttttttataagcaagtaaagccaataatgaaactgcagcaataatgaaacgataccatacgatagtttgcgcattcattacagacaaaacttgtttcaaggcaataggcaatgacccccaagccatagcggtaataagcgcaaaggtaaagcctaataaaggttgttgtttcattgtttgctcgcttatgtgaaattaaaaaagacaaaacgccccanaaaattgtagggcgtttcaatggaatagattttaaattattcagtaacaataactacgtatttacggcttttctcgccttttacttcaaatttaactttaccatctgcggttgcgaataaggtgtgatctcttcccattcctacgttgttacctgcgtggaatttagtaccacgttggcgaacgataatgctacctgctaatacagattcgccaccgaaacgtttaacaccaaggcgtttagcttcagaatcgcgaccgttacgagttgaaccaccagcttttttagttgccatctacttgatctcctctgaaattatgcttgaatcccagtgattttcacttctgtgaaccactgacgatgaccttgttgtttacggctgtgtttgcgacgacggaatttaacgattttaactttctcgccacgaccttgtgcaacaacttcagccactacttttgcaccagcaactactggcgcaccaattttaacatcttcaccattaacgaccatcaacanagaatcgaactcaactgttgcgccagttgcaagttcaagtttttctaaacgaacaacttgaccttcgctcacacggtgttgtttaccgccactttggaaaactgcgtacataaatactccgcttaattgtgttttcctgctttttagcagtccacacttaaaaattcatataaataggtcgcaaattctacggaaaaatcctacctatggcaagattttatttataataaaataaaaaanttcccttcatttgcggattgatttcagaaagtctgaaaattcgggtaaaatgcaccgcacttttaactgataaatgatgaaaaatgaagaaacaagatcttatgagcatagacgagatccagaaacttgcagatccagatatgcaaaaagttaatcaaaatattcttgctcagcttaattcagatgtaccgctaataggacagttaggtttttatattgttcaaggtggtggtaagcggatccgtccgttgatcgcagttctcgcagcacgatctttagggtttgaaggatctaattcaattacttgtgctacttttgttgaatttattcataccgcttctttgttacacgatgatgtcgtagatgaatctgatatgcgtcgtgggcgtgctacggcgaatgctgaatttggtaatgcagcgagtgtgttggtaggcgattttatttatacgcgtgcatttcaattagttgcacagttagaatcattgaaaattttaagtattatggctgatgcgactaatgttttagcggaaggcgaagttcagcagttaatgaatgttaatgatcctgaaacgagcgaasstaattatatgcgtgtaatttatagcaaaactgcccgtttgtttgaagtggctggtcaggctgcggcaattgtcgccggtggaacagaagctcaagaaaaggctttacaagattatgggcgttatcttggcactgcatttcagctcgtggatgatgtattggattatagtgcaaatacgcaagctctaggtaaaaatgtaggcgatgatttagctgaaggaaaaccaacccttcctctactacacgctatgcgtcatggaaatgctcaacaggcagctttaattcgcgaagcgattgagcaaggtggtaaacgtgaagcaattgatgaagtattagctattatgactgagcataagtctttagattatgcaatgaatcgtgcaaaagaagaggctcaaaaagcagtggatgcaatcgaaattttgccagaaagtgaatataaacaagcgttgatttcattggcatatttgtctgtagatagaaattattagtccataatttagcttatatacttgatacccattaattttaattaaactttatgaatacagaacttcaacctaaactagaaaaaagtgcggtcaattttcaagctaaaccgcgaaaacaaaaaatccgtaaggatcctaacgcaccttttattcgtgaaaaacttgagttgccagatggacacaataagctccttttgcattcttgttgtgcgccttgctctggcgaagtgatggaagcaattcttgcatcaggcattgaatttacaatttatttttataatccaaacattcatccactcaaagaatatttgattcgtaaagaagaaaatatccgttttgcaaaaaaatttggtattccatttattgatgctgattacgatcgtcaaaattggtttgatcgtgctaagggtatggaatgggagcctgaaagaggtattcgctgcacaatgtgttttgatatgcgttttgaaaaagctgctgaatatgctcataaacatggtttccctgtatttactagttgcctaggtatttctcgctggaaggatatgaatcaaatcaatggctgtgggcatcgtgctgcggaaaaatatgatgatgttatttattgggattataactggcgcaaggaaggtggctcgcaacgcatgattgaaattagtaagcgtgagcggttttatcaacaggaatattgcggttgtgtgtattctttacgtgatagtaataaatggcgagaagagacgggtcgtcaaaaaattgaaatcggaaaattatattatagtgctgattaaaaatagaaaaataaaggtgttgtttcacagaatttgctgaacagcaccttttatttcactattttatcacttcatcttgatcataatgattaatttttaaacgttgaaaataatcttttgtttcttcaatgatcacttttcgcaatccaataagcgcgataagatttgggaaagccatcaaaccatttacaatatcggcgataatccatattaaatttaagtgtaagaatgcccctaaaccaaccaacataatataagctagacgatatagttttacgccacgaataccgacgagataaacaaagcaacgttccccgtagtaacaccaacctaaaatagtcgtgaatgcaaaaaataataaaccaactgttacaatcgttgcgccaattgatgtgcctaaaccttgtgcaaaggcatagtttgtgacagtagcacccgctaattcaggattgttccacgctcccgttaataccaatacaatacctgtcattgtacagacgatgatggtatctaagaatgtacctgtcatggaaattaagccttgtcgaacaggttcacgagtttgtgccgctgcagctgcaattggtgcgcttcctaaaccagattcattggagaaaatgccgcgcgcaacgcctgattgaatcgctttcatcacagtaagccctacggcaccgcctaatgcagcttgtggatcaaaagcactatcaataatcaataaaatcgcatctggtactttttctatatttaaaaggataataaccagtgaagtcgtgacgtataaaatcgccataaacggcacaattaccgatgatgcggttgcaatacgttttacaccgccaagaataattaagccgactaaaagcgtcacaataattgcagtaactaaaactggaatattaaaagtatcttgcattgcatgggtaatcgcattgacctgtgggaatgtgccgatcccgaaaaaggccaccatcacaccaaataatgcaaataattttgctaaccatctgatacctagtccgcgttcaatgtaatacatcgggccgccagccataaagccatttttatcgcgaacacggtatttaacagcgagtaaacattcagcatattttgttgccattcctaacaaagcaaccagccacatccaaaaaatagcccctggcccacctgcttgtaccgcagttgcaacgcccacaatattacccgttccaattgttgcggctaatgcagtacaaagtgcagcaaaagaggaaacgtctccttttccacctttatcttttttgaacaaataacctagtgcgcgcggtaagtagcgaatttgaatgaagcctaagcgtaacgttaaatagagtcctgtaccagataataatataagtagaggtgcgccccaaataaagctatcaatagctgaaagaattgactcaattgtcattgtgattcctcgtcgtttaaatcaaaataaacacgacaagaagacgaaaagatacaatggaaaagaaagtgcggtaaaaaaataaataatttccacacttacaatagattgtcttttgcccctgtccttttgcctgagcgtttgaaaaacgattgaaaaattaaccgctcttttgcgcttcggcgtccatttctaaaatggatctctccaagggttcgtccagtaacagtccctgccatcgcacctgaaagattttacatcgtcggtgtggggtcaatttcccgctctccagctaccttcatccgaactcactttccattagatattgaaaagtgtgcgaattctaacaaaacaggaaatgaatttcaaaaaggaatttttatgtagaacaatcactttattcaatatctccacaaaaacgatagccttctccatgtatagtcataatgatatttggagtattgggatgatcttcaaaatgttttctgatacgtcgaattgtgacatctacggtacgatcctgaggttttaactctcgtccggtcatttttttcagcaattcttcgcgcgtttgcaattttcctggattttcacagaaatgtaacattgcacgaaattcactgcgaggaagtttgaattcttgtccttctggtgtaattaaactgtggctatttaggtctaatttccaaccattaaaacgatagaattctcgaccaaatgtattttctttttcttgatgcggcattgcacgatgcaatagattacgtgcgcggatagtcagttctctagggttaaaaggcttagtcaaatagtcatcggcaccaatttccaaacctaaaattttatccacttcattatctcgaccagttaaaaaaataagaggtaagcttaattcttcacggagttctcttgccaataataagccgtttttgcctggtaaattaatatccatcacaaccaaattaatattatgatttgccaatatatgatgcatttcaacaccattttctgcttcaaacacatcatatccttccgcttcaaaaatccctttaagcgtatttcgagtgacaatttcatcttcaacaacgagaatttttggagtagtcattttccatccttatacttattttggcgtatgctatcaaagctatcattctatctgtgcaacattattgtaacaataaaaaagtgcggtgattttttacctgattttcctttttgtgatctaaatcatagttttaggtattcaaatttctttgtgatagaatttcgagcatctatatttttatactcaattctatgaaaaaactctttcttttttttacgctgattttcaccgcttttgcggctaattcaggtttattcgataaaaaacaaacctttttaaaagtagatgatgcttttgctttttctgctactttatctacagataaaagccagttacaagcccattgggatattgccgatggctattatttgtatcaagataaaattagtgctgagttagtcggtaaatcaaatcctctctctttacatacccaacaagcggcggaattacatcaagatccttattttggcgaagtaaaagtttttactcactcaattgatggcatatttaggggtgcatttaataatgctgatgataaggttgaaatcacttatcaaggatgtaccgaaggtttttgctatccgcctgaaactaaagtattacgaattggggatttagtcgtttctcaaaagcaaattgtcgaaaaaacagttgaaaaaaataccgcacttttatctgaacaagatcgtttagctgatggtttattccatagtaaatgggcaatttttggtttctttgtattaggattgggactggcttttacgccttgcgtattgccaatgttaccgttgctttctgctattgttatcggtcagcaacaacgtccaaatatgatgcgagcgtttagtttagcttttctttatgttcaaggcatggctctgacttacactttgttagggcttgcagtggcagccatcggtttaccgttccaaatcgctttgcaacatccttatgtgatgatagggctttctattttatttgttgctcttgccctttcaatgtttgggttatttactattcaattgccaaatagcttacaaaataaactcaatacatggagccaaaaacaaacctcgggtgcttttggcggagcctttgcaatgggaatgattgctgggctggtggcatcgccttgtacatctgcgccactttctggtgctttactttatgtggcacaaagtggcgatttatttacaggcgcagtaaccctttatttgctcgcacttggtatgggcgtgccgctaatgttaatcacattgtttggtaataaaattttgcccaaatcaggtgagtggatgaataccgtaaaacaaacattcggctttgtgatgttggcgttacctgtatttttactttctcgtattttgcctgaagtatgggagccacgcttatgggctggattagcgacagtattttttatttggtttgcgttgcagatgtctaagaacggttttggctatgctattaaaattattagttttgcgttggctatggttactgtacaacccctgcaaaattggatttggcaaactcaaactacaacacaaagtgcggtagaaaatatgcctgtttctcaagttaaatttaagcaaattaaaaatactgaagaacttgaccgcactttagcggaaaatccgcattcaattgctatgttggatttatacgcggattggtgtgttgcttgtaaagaatttgaaaagctgacgttttcagatccacaagtgcaacagcaatttcaaaatatcttattgttacaagtgagtatgacaaagaatagcccagaaaataaagcattaatggaacgctttaatgtgatgggattgcctacgattttattttttgatcagcaaaataatgaaattaaaggaagtagagtaacgggctttatggatgctgatgctttttctaattggattgaaaagctactttagttattttttacttttggtaaaaagtatttttcaattttaattattgtttaactacccgttaaagattaatatgacgccgttttaattcatctttaaacaaaaggaaagcaaatgaacaatcttgaaaaatatcgcccgtatttcttggcatttttacgtatcgttgtcgcttatatgtttattttacacggcacggcaaaatttttggaatttccaatttctatgactggaggaaatggtgcagtaggcgatccaatgctactagtggcaggcgtaattgaaattgttggttccattttattaatcttaggtttatttacacgccaagccgcgtttattttgtcagtggaaatggcatatgcctatttctttctgcacgtagcaggaaaaggaaacctatttttcccaattgcaaatggcggcgagcttgcattactttactcacttctctttctatattttgtattttctggcgcaggtgcttgtgctttagataataagttttttaaaaagtagtttagttgtagtttcataattttatccttatttttgcccacatttatgtgggcttttttatgcctgaaatttatcgtatttttaccgcactttaagaaattatatttaatcttttctatatttaagcaaacgtttgcgttataattctcatcgcttatttttaactatttaatgaaaggaaaatacaatggcagatcgtccaattcgtcaggctttactgagtgtgtctgataaaacgggtattgtagagtttgctcaaggtttagttaaacgtggtgtaaaactactttcaacaggtggaacggcaaaacttttagcacaaaatgctttacctgtaatagaagtgtctgattacacaggtttcccagaaatgatggacggtcgagtgaaaaccttacatcccaaagtacatggcggtattcttggtcgtcgtggtacagatgatgccatcatgcagcaacatggcattgaaggcattgatatggtcgttgtgaatttatatccctttgctgccactgtggcaaaacctgattgcactttggctgatgcggtagaaaatatcgatattggggggcctacaatggtgcgttctgcagcgaaaaaccacaaagatgtagcgatcgtggttaataatcatgatttcaacgcaattctagccgaaatggatcaacatcaaaacagcctaacttttgaaactcgttttgaccttgcgattaaagcatttgaacataccgctcaatatgattctatgattgccaactatttcggtcagctagtaaaaccttatcatattgcagaggaagaagaggcgaatgcgaagtgcggtcaattcccacggactttaaaccttaacttcgtgcgtaaacaagctatgcgttacggcgaaaactcccatcaaaatgcggcattttatgttgatttaaatgtgaaagaagcgagcgtggctacagctaatcaactgcaaggtaaagccttgtcttacaataatattgccgacactgatgcagcacttgaatgcgtgaaagaatttgacgatccagcttgcgtaatcgttaaacatgccaatccatgtggtgtggcgttaggtaaggatattttagacgcttataatcgcgcttaccaaaccgatccaacgtctgcttttggcggcattattgcttttaaccgtgaattagacgaaaaaacggcgaatgaaattgtggaacgccaattcgttgaagtgattatcgcaccgaaagtttctgctgaagcgcaagaagtaatgaagcgtaagaaaaatgtgcgtttgcttgaatgtggtgaatggacttctcgttccgaacgtttggatttcaaacgtgtaaacggcggtttattagtacaagatgcggatttaggtatggttggcgtggatgatttaaaagtcgtgagtaaacgtcagccaactgaacaagaattaaaagacttattattctgctggaaagtggcaaaatttgtgaaatcgaatgccattgtttacgccaaagacaatcaaactatcggcattggtgcaggtcaaatgagccgcgtatattctgcgaagattgcgggtattaaagcgcaagatgaaggtttagaagtggctggttgtgtgatggcatctgatgcgttcttcccattccgtgacggcattgatgcggcggcgaaagtgggtattcaatgtgtgatccatccaggtggatcaatgcgcgatcaagaagtcattgatgcggcggatgaacataatatggtaatggtattgactggaatgcgacattttagacattaatttatctaactatccccctctttacaaaagagggggaattgcaggtaaaaaatagccgtactttttttaaattaggcatacgcaaggactacaacatgaacatcctcatcatcggaaacggcggtcgtgaacacgccttggcttggaaagttgcacaatctccattagcagataaagtttttgtcgcaccgggtaacgctggtactgcattggaacacaaagtagaaaacgtgaatatttctgcgacagatattccagcattagtgaaatttgctcaagataaacaaattggattaaccattgttggtcctgaagcccccttagtgattggggtagttgatgcatttcgtgaagctggattgaagatttttgggccagctaaagcggctgcgcaattggaaggttcaaaggcattcactaaagattttctcgctcgtcataaaattccaacagcggaatatcaaaacttcaccgaagtcgaacctgcattgacttacttgcgtgaaaaaggcacaccaattgtcgttaaagcggatggcttggcggcgggtaaaggcgtaatcgttgcgatgacattgcaagaagccgaagatgcagtacgcgatatgctttctggtaatgcctttggcgaagcgggcagccgagtagtgattgaagaatttctagatggcgaagaagcaagttttatcgtcatggtagatggtaaaaacgtagaacctatggcaagcagtcaagatcataaacgcgtgggcgaaaatgatacagggttaaatacaggcggtatgggcgcatattcgcctgcaccagtaataacacccgaaattcatagtcgcattatgaaggaagtgatttacccaaccgttaatggcatggcagcggaaggcaatgtttacacgggtttcctatatgcaggattaatgattatgccaaatgggcagccgaaagtgatcgaatttaactgccgttttggcgatccagaaacgcagccaataatgctacgtctcaaatcagaccttgttgaactctgtcttaaagcatgtgacggcaaattagatgaagtaatatcacaatgggatctgcgagcttctttaggtatcgtattggctgcagagggatacccaaaagattatcgcaaaggcgatgaaatcagcggattgcctaaaagtgcggtcaaaaacgagaaagttttcttagcgggtgtcgcagaacaagaaggcaagctagtcacaaacggcggtcgtgtactttgtgtgactgcgttaggcgaaagtgtatttgaagcacaacaaaaagcgttaaaattggctgagcaaattcaatggtctgggcgtttttatcgtcgagacattggttacagggctgtggaacgagagttgcaaaaataatccatatcattatgatgaattaatttcatttaagtgatgaaaatttaggaatgaaattttaattaaatttttatccataaacagttaaactatctgccataaattacataacaggagaacacaatgtttacaagaaatatgactatcgctgattacgatccagtattgtggcaagcgattcaagatgaaaatcgtcgtcaagaagaacatatcgaactcattgcatctgaaaactatgcgagtccacgtgtgatggaagcgcaaggttcacaattcactaataaatatgcggaaggctatccaggtaaacgttattacggtggttgtnagtatgctgacattgtggaacagttagcaattgaccgtgcgaaagaattatttggtgcagattacgtgaatgttcaaccgcactctggatcacaagcgaatgctgcggtgtatggtgcattgattaatgcaggcgatactattttaggtatggatttggctcacggtggtcatttaactcacggtgcaaaagtcagtttctctggcaaaatttataactccgtactttatggaattactgcggatggcttaattgattatgaagatgttcgtcaaaaagcattagaatgtaaaccaaaacttatcgttgctggtttctcggcttattcacaagttgtggattgggcgaaaatgcgtgaaatcgcagatgaagttggtgcgtatttatttgtggatatggcgcatgtagcgggattaattgcagcgggtttatatccaaatccactaccgcatgcacatgttgtgacaacaacaactcacaaaacattgggcggtccgcgtggtggtttaattctttcatcttgtggcgatgaagaaatctacaaaaaattacaatcatccgtattccctgcaaaccaagggggtccattagttcatattattgcggcaaaagcagtttgctttaaaggagcattagagcctcaatataaagaataccaagcaaatgtaatcaaaaatgcaaaagcaatggttgaagtatttaaacaacgtggttatgacgttgtgtcaaatggtactgaaaaccacttgttcttagtaagtttcatcaaacaaggattaacaggtaaagcagcagatgcggcattgggcaaagcaaatattaccgtgaataaaaatgctgtaccaaacgatccgcaaaaaccattcgtcacttctggcatccgtgtaggtacaccatctgtgactcgtcgtggtttcaatgaaaatgatgtgcgtgaattagctggctggatgtgtgatgttttagatgctttaggcaaagaaaatgaagaacaagtgattgctgaaactaaagaaaaagtattagcaatttgtaaacgtcttccagtttatccgaaatgatttattttctttcgttgattatatggttagcggcgattaatatcgccgcttattttttatgggaaattatatgacttatattgttggcttaactggtggcattggtagtggtaaaacaacgattgctaatttatttaccgatcttggcgtacctctagtggatgcggatgtggttgctagagaagtcgtcgcgaaagattcccccttattgtcaaaaattgttgaacattttggggctcaaattttaacggaacaaggcgagcttaatcgcgcggctttacgagagcgagtgtttaaccatgatgaagataaattgtggttaaataaccttctacatcccgctattcgtgaacgaatgaaacaaaaattagctgaacaaactgcgccttacacattatttgtcgtccctttattaatagaaaataaattgaccgcactttgtgatcgtattttggtggtggatgtgagtccacaaactcaacttgctcgttcagctcaacgagataacaataattttgaacaaattcaacgaattatgaattctcaagtttctcaacaagagcgtttgaaatgggcggatgatgtgattaataatgatgctgaactggcccaaaacttaccgcacttgcagcaaaaggtgctagaattgcaccagttttatttacaacaagcggaaaataaaaatgcctgacgaaatgattgaagtaccttgtccgatttgccaaaaatcggtgccttggataaatgaaagtacttttcgacctttttgtagcaaacgttgccagttaattgatcttggcgaatgggcggctgaagaaaaagcgattccaagtgatactgctgattttgcaatggatccaaatgtgagtgacgaatggagcattaaatagagattaaccgataggaaaccctatcggttaatttttataagtgcggtgctttttttgaggatttttcctaaaaatgctatgctaaacgtaattttattattctaaaatgtgatttttatgcaacaagattatttaagccaacaacgattctccgctcttcctctacacccgattgtgcgaggtgctttggcaaaaaaaggctttgatttttgtaccccaattcaggctttatccttgcctatcagtttaaatggacgagatgtcgcaggacaagctcaaactggtacaggcaagacaatggcttttttaacggctacttttcaccatcttttaactcaccaagatcctaatcttaaatatcctcacccaagagctttgattttagcacctactcgagaattagcggtacagattagtaatgacgcagaatttcttgcaaaagcgagtggattaaagaccgcacttgcctatggtggcgatggttatgataaacaactacaagcgattgagcgtggcgtcgatattttgattggtacgacggggcgagtcattgattatgtgaaacaaggcgtaattggtttagatgaaatccaagttgtcgtgctagatgaagcagatcgaatgtttgatcttgggtttatccgtgatattcgttatttattgcgtaaatgccccgctccgcaagctcgtttaacgatgttattttcagcgacgctttcttataaagtgcgtgaattagcatttgaagatatgaatgaacctgaatatattgaaattgaaccagaacaaaaaacagggcaccgaattaaagaagaacttttttatccatctaatcaggataaaatggcacttctcttaaccttaatggaagatgaatggcctgaacgctgtattgtatttgcgaatacgaaacatcgttgtgaagaaatttggggctatttggcggctgatgggcatcgtgtcggtttactgactggcgatgtagcacagaaaaaacgtttatcgttattaaaacaatttactgatggtgatttggatattttagtggcaacagatgtggctgctcgtggcttgcatatttctgatgtgacgcatgttttcaattatgatttacccgatgatcgagaagattatgttcaccgaattgggcgtactggacgagcaggggaaagtggtgtttcgattagtttcgcttgtgaagaatatgcgatgaatttaccagcaattgaagaatatattggccattctatccctgtgagccaatatgaaacagaagccttgcttgaactgccgaaaccgtatcggttgaaacgtgcggtgccaccgcaaggacatacaagacatcgttcttatcacgcaaaataggtgggcttcagtccacgcgtttatttaatgatgaaaagtgcggttaattttgactgcattttatattcctattttttatatcctactttgttcatcattcatcttgtgggtttacggcttacctacagataagtattgttacgttttttgttttttaacttgccaaaaaacaaaaaataaataaaatgaacgctcattcatttttgagcaattattgctccttattttactcaaggatcttatgcgacaagctaaaacagacttagctgaacagattttttcagcgacagatcgtttaatggcaagagaagggttgaatcaactttctatgctcaaacttgcgaaagaagcaaatgtagccgcaggaacgatttacctttattttaaaaacaaagatgaattgcttgaacaatttgcacacagagtgttttcaatgtttatggcaacacttgaaaaagattttgatgaaactaagccttttttcgaacagtatcgacaaatgtggaaaaacatttggtatttcttacaagaaaatcccactattctatccaatttaaagcaatatgaatctttgccgaatttcaaggatatttgtaaaaacattaaaaattgccgttgggatttattttgtcatcaagcacaaaaagctggcttattagcggaattatctgaagatattctctttttattaagtttgaaaacggcgataaatttagcctctgatgcaaaatttatcgatttcgatcttaagcctgaaattttagaatctgtgattgancgctcttggcgtgcgattcagaaataattgtngttatttttataacggagctttaaacatgagtcaaactcaacatcaaagaccaaaacgctcacatattttcttgatgaaaataattttagtggtatttgtcttaatttttgtcggtgtcatcggttttaatatgataaaaggcgtaatgataagccgagccattgcaggaatgccagaatcttcaagcccagtaaccgcacttgaagttcaaccgcgtgaatggacgccagttattaacacaacaggtcttgtgcgtccaaatcaaggcgcaatgctcagtacacaaaatgcgggcgcggtttcacaagtacttgttcaaaatggacaaaatgtgaaaaaaggtgaggtgcttgtggagcttgatagttctgttgaacgagctaatctacaagctgctcaggcacaattatcagcacttcgtcaaacttaccaacgttatgtgggtttattaaatagcaatgctgtatcacgtcaagaaatggataacgcaaaagcggcttatgatgctcaagtagctagtattgaatctctaaaagcagcaattgaacgtcgtaaaattgttgcgccatttgatggcaaagcaggtattgtgaaaatcaatgttggacaatatgtgaatgttggaacagaaattgtgcgtgtagaagatactagctcaatgaaagtggattttgctctttcacaaaatgatttagataaattacatatcggtcagcgcgttacagcgacaacagatgctcgcttgggcgaaacattttcagctcgaatcactgcgattgaacctgccattaattcatcaacaggtttagttgatgttcaggctacttttgatcctgaagatgggcataaattgctttcaggtatgttctctcgcttacgcattgcacttccaactgaaacaaatcaagttgtcgttccacaagtagctattagctacaatatgtatggcgaaattgcctatttacttgaaccattatctgaagaagaaaaaggaaaaatgtcaggtaatgaaaaattggatcgtctctatcgtgcgaaacagatcaccgtatttactaaagatcgtcaaggtgtttatgctcaattacagggaaatgaagttaaagtgggagataaaattattacaggcggtcagcaaggtattggtaatggaagtcttgtggaatggattaaaaaagacattgtgggtgcaatagagcctgcacataaaacaccactttaatgtatgaggaaatccgaatgaaatttaccgatatatttattcgtcgtcctgttttagcagtttcaattagtttgttaatgattattttagggttgcaagcaatctcgaaattggcagtgcgtgaataccctaaaatgactactacagtcattacagtgagtaccgcatatccaggggcagatgcgaatttaatccaagcatttgttacgtcaaaattggaagaatctatcgcgcaagccgataatattgattatatgtcttcgactagtgcgcctagtagttcgactattacaataaaaatgaaattaaataccgatcctgcaggcgcgttagcagatgtgttagccaaagtgaatgcagtaaagtcagcattaccaaatggtattgaagatcctagtgtatcctcttcttcaggtgggagcggtattatgtatatcagtttccgatctaaaaaactagattctagtcaggtaactgattacatcaatcgtgtagtcaaaccacagttttttaccattgagggtgttgccgaagtacaggtatttggtgcagctgaatatgcattacgtatttggctagatccacaaaaaatggcagctcaaaatctttctgtgccaacagtgatgtctgccctttctgcaaataatgtacaaacggctgcggggaacgataatggctattatgtgagttatcgtaataaagtagagactacaacgaaatcagtggaacaactcagcaacttaattatttcatcaaatggcgatgatttagtgcgtttgcgtgatattgcaaccgttgaattaaataaagaaaatgataattcgcgtgctacggcaaatggtgcagagtccgttgtgttagccatcaatccaacctcgacagcaaaccctttgactgtcgcagaaaaaattcgccctttatatgaaagtataaaaacacaactgccagacagtatggaaagcgatattctttatgaccgcactattgccattaatagctctattcacgaggtcataaaaactattggtgaagctactttgatcgttttagtggtaattttaatgtttatcggttcgttccgtgctattttaattccaatattggctattccaatttctcttattggcgtattaatgctgctacaaagtttcaacttttctattaatttaatgactttgcttgctttaattcttgccataggtttagttgtagatgatgctattgtggtgctggagaatattgatcgtcatattaaagcgggagaaacgccattccgagcagcaattattggtacgcgtgaaattgcagtccctgttatttctatgactatcgcattgatcgcagtttactcaccaatggctttaatggggggcattactggcacattgtttaaagagtttgctttaacccttgctggtgcagtatttatttctggtgttgtggcattaacgttatcgccaatgatgagtagtaagttactcaaatccaatgctaaaccaacatggatggaagaacgcgtagaacataccttaggtaaagtaaatcgtgtttacgaatacatgcttgatctcgttatgctcaatcgtaaatcaatgctggcttttgcggtcgtgattttctcaacgctcccatttttgtttaattcactttctagtgaattaacgccaaatgaagataaaggcgcatttattgcaattggtaacgcgccatctagcgtaaatgtggattacattcaaaatgcaatgcaaccatatatgaaaaatgtaatggaaacacccgaagtttcttttggtatgagcattgctggtgcgccaacttctaatagctcgttaaatatcatcacattgaaagattggaaagaacgttcacgtaaacaatccgcaataatgaatgaaattaatgaaaaagcaaaatcaattccagaagtgtcagtatcagcatttaacattcctgaaattgatacaggggaacaaggccctccagtctctattgtattgaaaactgcacaagattataaatctttggcaaacaccgcagagaaattcctcagtgcgatgaaagcctctggcaaatttatttatacaaatttagatttgacctatgacactgcacaaatgactatttctgtggataaagaaaaagcgggaacttacggtattacaatgcaacaaatcagtaatactttagggagtttcttatctggtgcgacagttacgcgtgtggatgtggatggacgcgcttataaagtcatttcgcaggtaaaacgagatgatcgcttatcgccagaaagtttccaaaattattatttaactgcatctaatggtcaatcagtgccattaagtagtgttattagtatgaaattagaaactcagccaacatcattaccgcgtttcagtcagttaaattcggctgaaatcagtgctgtaccaatgccgggtatatcaagtggtgatgccattgcttggcttcaacaacaggcaacagacaatttaccgcaaggctatacgtttgattttaaatctgaagcacgtcaattagtccaagaaggcaacgcattagccgtcacttttgcattggctgttatcatcatattcttggtacttgccattcagtttgaatctatacgtgacccaatggtaattatgatttctgtaccattagccgtaagtggtgcattggtgagcttaaatattttatccttctttagcatcgcaggaacaacattaaatatctactctcaagttgggttgattactctcgtgggattaatcaccaaacacggtatcttaatgtgcgaagtggcaaaagaagaacagcttaaccatggtaaaactcgaattgaggcaatcactcatgctgcaaaagtacgtttacgcccaatcctaatgacaacggcggcaatggtagctggcttaattccattactctatgcaacgggtgcaggagcggtatctcgctttagtattgggatagtgattgtagcgggattatccattggtactattttcaccttgttcgtcttgcctgtagtatatagctatgtcgcaactgaacacaaaccattaccggtttttgatgaaaataaaacaacccactaattaaaacatagaaaaaacaaaccgcacttaggttatcttacgtaattcgtacttataaatagttgttttatccaacttttttgagcataacctgcataagtgcggtatttttttattctgttaattatataaataatccacttatgttagtctttatttaaagactatttttcagtaaacttagcgaattttgttgaattattaaaattatcacttcaaatctaggaatttattgtggcacatcgagattttctgcgcgtcgtagctcaaataataagaaaaaaaataagaaaaagaatacaaatgtcttgatttttcttgctttatttattgttctagtttttgttgttggactttatttgttgaaaaatcagaacagtaaggtaagcgtgcagcaagctataacacaacaggaaaaagctcaacctaaaagtgtgttacctaatcgtccagaggaagtgtggagttatattaaagccttagaaacgcgtactgtacctgtagataataatccagcgagtgtagaacaaaatatgcgtttaacagaagaacaacgtcaagttttaattcaaatagaaagagatcaaaaagcggctgatgaagctagaaaactggctgagcaacagagaatagaagatgcaacgagaactcaatccaaaacaacggaagatatgaaaaatacagaggcagaaatcgtaaaatcggaatcaattaaaaagcaagactcacagaaaattgaaagcgcaaaaaaagtagaacaaataaaaacggttaataatgtacgggatagcaagaaatttggtttacaatgcggtgcttttaaaaatcgagcacaagctgaaaatttgcaaggtcgtttacagatgacaggattaaatgctcaaatacaaactaacggcgaatggaaccgtgttcgtgtagcaagttttgatactcgagagcttgcagtacaggcgcaaagtagagccaaaactgttaccgattgtgttgtgattggtatgtaatatatatttatttattttaatgctgagtaccaaaaggtggttttgcaaaccaaatcacaataagcaatcctaagaatcccatagcggataaccaaaatatttcatttgcgccaataataaatccttgcgatgttatttgttgagcgaggtaagctgaagtttgcgtatcacttaaaccaaattgattcatttgatggtaaaaactttgggaaattgggttataaggattaatgtgttctgttaattgagtgtggtgaacagcttcacggttataccacataaatgtggtcaaagatgttcctacagaacccgctaaagttctcaaaaagttaaataagctagaggctgaagccattttatgcgcaggcaagccagacagcgttattgtagtaagtggcataaagaaacaggacaccgctaaaccttgcactaattgtggtaaagctacatcaacaaatgtcattgatggctcgaaagttaccgctcgccaataaaatgttattgcatatacaataaagcttatcgtcactaaaattcgcatatcgatcttataaccgaaacgcccaataatcggtgaaagcaaaattgggaataatccaactggggaagctgcaagccctgcccacgtcgcagtgtaatggaagacttgttgtagcaagagcggaattaataccacagaacctagataaatcaaaaaggctaaactagtacataaacaccctacgctaaaattacgagaatggaaaagcgaaatatccactacaggattgtcatctgtcaattcccaaataaccaaggcaatcagacaaacgacagcaacaacggctaatataatgatttcattagaattaaaccaatcttgctcacgaccctgatcaagcattaattgcaaacatcccacgcctaagacaagtaaaactaaaccgactttatcaataggttgatgaacaatttcactttctctgcttcccaaaatcttccagctgattagcacaactgacaaaccgatcggaacattgataaaaaagatccatccccaatggatattatcgctaatccatccgcctaaaattgggccaaaaataggcgcaaccacaatagtcattgaccaaaatgccaatgccattccgcgtttttctggtggataattatttaataataaactttgcgaaagagggatcactgggcctgcgacagcaccttgaatgacgcgaaaaataattaacgcctcaagactatctgcaatcccacagagccaagaagagacaacaaataaaaaagttgagactaaaaataaccgcacttcgccaaaacgttttgctaaccaacccgttattggaatagaaatcgcatttgctaccccaaaagaagtaattacccacgtgccttgactaaaagatgcgccaagatcgcccgcaatagtaggaattgccacatttgcaatggtagaatctaatacctgcataaaggtggcaagagataaagccagcgttaataaaatcagcgcaccaccttgaataggcgggaatttttttgcggaattgcccataacgccgccttaatggctgttttgctgaatgatagattcaatcaaattttctaccgcactttcatcatatttaagtgtatcagtagaaaataacgttttcggttctgttttttctcgtagcattgcgcctgatgaatctgaaattcttacttttgccgttgcagaaagaccaattctcaatggcgtttctgtaaattgttgtggatctaatttaattcgcacaggtacgcgttgcaccactttaatccagttacccgtagcattttgtgaaggcaaaagagaaaatgcattgccagtccccatttcaataccatttatcacgccatcaaattctttatttttaccgtataaatcaaaatggatttttactggctgaccaatgcgcatattcgttaattgggtttctttgaagttagcttctagccacatttgttcattagataccactgccattaacgcgccacccactgaaacggcttgcccaacttgaacattacgacgcgccacatagccatcaattggacttctaatttttgtacgttgcaaatttaaccaagcctgtttaagcgagtttatcgcattctgtatttgcggttgttcacgtaatggaacgttacgcaataaagcctgattagcagccaattgatttttagaggcatttaaatttgctttggcaagctcgacagcttcttttgcgtgttggaaagattctttatcaatcgcacccattttttcaagttgaactcggcgcgccaaattgccttgagcttgagctaaagaaatttcattggcgtgcacagctgattgcaattgctgcacagtgaaacccagttgttctacctgacgtacagcattggcgagattgcttttggcctgttcgaaactaagtttcgcattggtatcatccaattcaactagaatatcacctgcatggactttatccatattgtctgcattaatcttcgctacattacctgcaacttgtgatgataccattacttgatttccacccacataagcatcttctgtttcttcaaaatccttcaagaagaaaaaccaatacaaagcacaagcaataccaataataagcaggagaagaataaaaatgcttaagccttttttacggtcagttttatttgatacagatttagttgatgggttttcagttgcaatttgcgtcataatgccttccctaagctgggataatgtttaaaaatgagatatttgagataacctttaaaactatcaaaaataaaaatgaagggtcattatgaaactttaaaaaggggaactcaagggaaatcatcatctctttattttctagattaatgaatattctaaagatatagtctcattaatttgatttattttcgtgtaagaatcaaaaatcgacaatcatagcgattttgttcatccgccttacgatattcatcaaattcaatttcccactcctcccaattcaattgagggaaaaaagtatcgccatctagttctgtttgaatttgagtaaggtataacttatctgctttgggtaaatattgtttgaataactctcccccaccaatcaacataatttcatcaaaatctctgacaaaattgaccgcactttcaaagctatctttccatatcacaccttcgtgttcaaaaagctggcgagaaagtacgatattggtacgtttaggtagtggacgaccaatactttcaaaggttttacgccccataatgacaggtttaccagtggtgttctgacgaaaccaagctaaatctgcaggcaagtgccaaggcatttggttatctttaccaatcacattatttaatgttgtcgccacaattaaactaaatgtcataaatccccctaaaatttgccgttactatacctgatattaagtgatttttcattgatttagtgataacgttaatgccaattttaagaacttggaaaggattatgaacaaaaaaacaatcgttgtgaaattcggtacaagcacgctaactcagggttcgccaaaactgaattcgccacatatgatggaaatcgttcgtcaaattgcacaactgcacaatgatggatttcgtatagtgatcgtgacttctggtgcgattgcagcgggtcgccattatttaaatcatcctcaattaccacccactatcgcctcaaagcaactgcttgcagcggttggtcagagccaattaattcaggcttgggaaaaattatttgctatttatgatatccatatcgggcaacttttattaacccgtgcagatattgaagatcgcgaacgttttttaaatgcgcgagatactttatacgcacttttagataaccacattattcctgtgattaatgaaaatgatgcggtagcgactgcggaaattaaagtaggagacaatgacaatttatcggcattagtcgctattcttgtgcaagcggaacagctttatttattgactgatcaacaaggtttatttgatagtgatccacgtaaaaatcctgaagcgaaattaattccagttgtagaacaaatcaccgatcatattcgatcaattgcaggaggaagtggtacaaatcttggtactggtggaatgatgaccaaaatcattgctgccgatgttgcgactcgctctggaattgaaaccattattgctccaggtaatcgcccaaatgtaattgcagatcttgcttatgaacaaaatattggtacaaaatttattgcacaccaatctgatcgattagaaagccgcaaacaatggcttttcgccgcaccatcggcaggtattattaccattgataacggtgcgcaaaatgccattcttgaacaaaataaatctttattacccgctggtattattaacgtggaagggcgtttttcgcgtggtgaagtagtcaaaatacgcactcaatcaggtaaagacattgcgctgggtatgccacgctataacagcgatgctctacaattaattaagggcagaaaatcagcagacattgagaatgttttaggctatgaatatggcgcagtggcaatgcatcgtgatgatatgattattttgtcataatgtcctttggttgataaaagcactgatttatgaaacaatcttgagctatttttataggaaaaatttaaggtaaaacgatagtgatcgattttgatggctaccgtccaaatgtgggtattgtgatttgtaatcgcaaagggcaagtgctttgggcgaagcgttgtgggcaaaattcgtggcagtttccgcaaggtggcattaatgataatgaaagtgccgagcaagcgatgtatcgcgaactacacgaggaagttggtttacaacctaaagatgtgcgtctgttatatgtttctaaacattggttacgctataaattgccaaagcgtttattgcgttatgacagcaagccgatgtgtattgggcagaaacaacgctggtttttgctacagcttgttagcgatgaaaaaaacatcaatatgcaaacaactaaatcgccagaatttgatgggtggcgttgggtaagtttttggtatcctgttcgtcaagttgtgtcttttaagcgagatgtttatcgaaaggtaatgaaagagtttgcttcgatactatttacggacaatccactaatattttccgcatctcgtgaagcaaattcactgcattattcggcaaacaaaaaatattctcagacaaaatacacgaaacgccatttttataaatcaagaggccaataatgttcacttttattcttctttgtttacttgttggcgcattagcgggttttcttgcaggattatttggtatcggcggtgggttagtaattgtgccaacgttagtgtatttactgcccattgtagatgtaccagaatctttgttgatgtctaccgcacttggaacatcatttgctaccattgtgattactggcattggatcggcacaacgtcatcataaattaggtaacatagtctggcaggcagttcgcattttagctccggttattatgctttctgtttttatttgtggtttattcattggaagacttgatcgtgaaatttctgccaaaatttttgcttgcttagtggtatatttagccacaaaaatggtactttcgattaaaaaagatcaagtcacaacaaaatcacttacccctctttcttccgtaattggcggtattttgattggtatggcatctagtgctgcgggaattggcggtggtggatttattgtaccgtttttaactgctcgtggcattaatatcaaacaagctatcggttcttccgcattttgtgggatgttattgggcatatcagggatgtttagttttatagtgagtggttggggaaatccattaatgcctgaatattcgctcggttacatttatcttcccgcagtgttaggtattactgccacttcattttttacttccaaattaggcgcaagtgcaaccgctaaattgcctgtttcaaccttaaaaaaaggtttcgcccttttcttaattgtggttgcgatcaatatgtttctgaaataaggaaaattatgaattcaaattatttacttcttccccactttgatccgagtatttttacgcttggcgatagtaatatcggcttacgttggtatggcttgatgtaccttttaggttttgtttttgcacgttggcttgcggttcgccgtgctaatcgcccaaatagcggttggacagtagatcaagttgatagcttacttttcaacggttttatgggggtgtttattggcggacgtgttggcgatgtatttttctataatctcgatcatttcttacaagaaccactttatttattccgcgtttgggaaggtggaatgtcgttccacggtggcttaattggtgtaattgttgctatgatttggacatcttattctcaaaaacgtaatttttggcaaacggctgattttgttgcgcctttgattccgtttggtttaggtttaggcagaattggtaatttcattaatcttgaactatggggacgcgaaacgaatgtgccttgggcaatgattttcccgaatgatcctcttttactgcctcgtcatccatcacaactttatgaagcctttttagaaggcctggtgttgtttacgattctgaatatttttattaaaaaaccacgtccaatggcttctgttgcaggtttattcttaattggttatggcgtcttccgttttattgtggaatatgtgcgtgaacctgaagttgaaaatttctttgggattattacacgagggcaagccctttgcttgccgatgattattggtggtgctttcattatggcttgggcttattcacgcaaaagtgcggtcataaaataggagatttttatgaagcaatatcttgagctttgtcgccgcattgttagtgaaggggaatgggttgctaatgaacgtacaggtaagcattgcctcacggtcattaatgcagatttagaatatgatgtggcgaataatcaatttccgctgattactacccgtaaaagttattggaaagcggcgattgctgaatttttaggttatattcgtggatatgacaatgccgctgatttccgcgcacttggcacgaaaacttgggatgctaatgcgaatgaaaatgcagcttggcttgcaaatccgcatcgtagaggcgttgatgatatggggcgcgtatatggtgtgcaaggcagagcatggcgtaagcctaatggagaaactatcgatcagctacgtaaaattgttaataacttaacgaaaggtattgatgatagaggagagattttaactttttttaaccctggggaatttgatcttggttgtcttcgtccttgtatgcatacgcatactttttctcttgtgggcgatactttacatcttactagctatcagcgttcctgtgatgttccgcttggattgaatttcaatcaaattcaggtgtttaccttcttagcacttatggctcagatcacgggcaaaaaagccggcaaggcatatcataaaattgtgaatgcgcatatttatgaagatcagcttgagttaatgcgtgacgtacaacttaaacgcgagcctttcccattaccaaaattagaaattaatccagatataaaaacgcttgaagatttggaaacttgggtcacgatggatgattttaaagtcgttggctatcaatcccacgaaccaattaaatatcctttttccgtctaatggatgcagcaaaagtgcggtcagaatttgacgagaaaatgatgcgctacgcccttgagcttgccgataaagcggaagcgttaggtgagattcctgtgggggcggtgctggtggatgacgctagaaatattattggagaaggttggaatctctccattgttcaaagtgatcctactgcacatgctgaaattatcgctttgcgtaatggtgcgaaaaatattcaaaattatcgcctactgaatagcacgctttatgtgacattagagccttgcacaatgtgcgcaggggcaattttgcatagccgtattaaacgtcttgtgttcggtgcatctgattataaaactggcgcgattggatcacgttttcatttttttgatgattacaagatgaatcatactttagaggttacatctggcgtattggcagaagagtgtagtcaaaaattgagtacattttttcagaaaagacgcgaggagaaaaaaatagagaaagcattattaaaaagtctgagtgataagtaattctttattttttcttatatttgaaacttaaaatccaggattgatcgttatctcaaatcctgttacttgcggaaactcttcttgaatgagtttcaacaattctgtctgtctgaataaaattccttggcgaacgatcgcatttgctgtctcaataaaaattgagttatctgtcatattaccaatacgaaatttgccgtgaaattcctgtggaaaaatgcggttaaatttttgattgatttcattgatagcaagaccttttttgattattttggcaaagggcgattgctcaagcacatccgtaatattgactgctttttgataacgctcagccttgttttccataaagtctgcccccagtaaatgacattagtttagatttccgttacaatacacgcaattttcataataaacaacgagacgaatgatttcaggcactgtcaaaccgaatttttggtcgcgattacttttaagtatcatcgcaatttttgctttgcctaacgcacaaagttttgaaaatcaaaataatacggaaaattattcctcaagtgtttccattcaacaagcgttagaaacggtaaaagttgctcgtgaagtgcaacgacaagccattcctcaaccttcaatttcccgtcaaactgaaaaacaacttaaaattcaaccgcacttttttactgaagcgttgaatattagcgcgccaattcgagcaggccccttgcttatttaatttttctgttttttgtgaagaatattgctattgaaatagcgatattttaaaaaattattgtgcatgaaataaagtatttcataagcatttaactatttaacttatatatttaaaaagagaaattatgagcattttaacaagaatttttggtagtcgtaatgaacgcgttttacgtaaattaaaaaaacaagtcgtaaaaattaataaaatggagcctgcttttgaggcattaagtgatgatgaattaaaagcaaaaacacaagagtttcgtgatcgtttaagtggtggcgaaactttgcaacaaattttaccagaagcattcgcaacggtacgcgaagcaagtaagcgtgtgcttggtatgcgccattttgatgttcagcttatcggtgggatggtattgactaaccgctgtatcgcagaaatgcgtactggtgaaggtaaaacattaacggcgactttgccttgttatttaatcgcacttgaaggtaaaggcgttcacgtggtaaccgtgaatgattatcttgctcgccgagatgcagaaacaaaccgtccgttatttgaatttttaggcatgagtgtaggcgtcaatattcctggtttatcgccagaagaaaaacgtgcagcttatgcggcagatattacttatgcaaccaatagtgaacttggttttgattatttacgtgacaacttagcccactcaaaagaagagcgtttccaacgtactttaggctatgcgttggtggatgaagtggattctatcttaatcgatgaagcgcgtacgccattgattatttctggtcaggcagaaaacagttcagagctttatattgcggtaaataaattgatcccaagtttaattaaacaagaaaaagaagatacggaagaatatcaaggagagggcgatttcactttagatttgaaatctaaacaagcgcatttaaccgaacgtggtcaagaaaaagtagaagattggttaattgcacaaggtttaatgcctgagggggactctttgtattctcctagtcgaattgtattgcttcatcacgttatggctgcattgcgtgcgcacacattgtttgaaaaagatgtcgattacattgtgaaggacggtgaaatcgtgattgttgatgaacacactggtcgtacaatggcggggcgtcgttggtcagatggtttgcaccaagccattgaggcaaaagaaggggtggatgttaagagcgaaaaccaaactgttgcatcaatttcttaccaaaactacttccgtttatatgaacgtcttgcgggtatgacggggactgcggataccgaagcatttgagttccaacaaatttatggcttggaaactgttgtaattccaacaaatcgtccaatgattcgtgatgatcgcactgatgtgatgtttgaaaatgaacaatataaatttaatgcgattattgaagacattaaagattgtgtagaacgccagcaaccagtattagtggggacgatttcagtcgaaaaatcagaagaattatctaaagcgttagataaagcaggtataaaacacaatgtgttgaatgcgaaattccaccaacaagaagcggaaatcgtggcagaagcaggatttcctagcgcagtgactatcgcaacgaatatggcgggtcgaggtacggatattattcttggcggtaactggaaagcgcaggctgccaaattagaaaatccaactcaagaacaaattgaagcccttaaagcagagtgggagaaaaaccacgaaattgtaatgaaagcgggtgggttgcatattatcggtacagagcgtcacgaatctcgccgtattgataaccagttgcgcggtcgttctgggcgtcaaggtgaccccggttcttctcgtttctatctttctttggaagatggtttaatgcgcatttatttgaatgagggtaagctcaatttaatgcgtaaagcgttcacggtagcaggcgaggcaatggagtcgaaaatgttggcgaaagtgattgcatctgctcaagcaaaagttgaggcgttccattttgatggccgtaaaaacctacttgaatatgatgatgtggcaaatgaccaacgtcacgcgatttatgagcaacgcaatcatttgcttgataatgatgatatttctgaaactatcaacgctattcgccacgatgtgtttaatggtgtgattgatcaatatattccaccacaatctttggaagaacaatgggatattaaagggcttgaagaacgtttatctcaagagtttggtatggaattaccgatttctaattggttggaagaagataataatcttcacgaagaaagtttgcgcgaacgcattgtggaaattgcagaaaaggaatacaaagaaaaagaggctttggttggcgaagacgctatgcgccattttgaaaaaggtgttatgttgcaaaccttagatgaactttggaaagaacacttagcttcgatggattatttacgccaaggtattcatttacgtggctatgcccaaaaagatccaaaacaagagtataaaaaagaatctttccgtatgtttacggaaatgttggattctttaaaacaccaggttatcacggctttaacccgtgtacgtgtgcgtactcaagaagaaatggaagaagctgaacgtgctcgtcaagaaatggcagcacgtatcaatcaaaataatttacctgtggatgaaaatagtcagacaactcaaaattcagagactgaagattattcagatcgtcgcattggtcgcaacgagccttgtccttgtgggtcgggtaaaaaatataagcattgtcacggcagtcgtgtggcacgccagtaatgaacaatcaaagtgcggtgatttttcaccgcacctttttcatacctctacattggatagaaaaatggataaaaaaattatacaagttgctgcggggattattcgtaatgaatttggtcagatctatttaacgcagcgtttagaaggacaggattttgcccaatctttagaatttcccggtggaaaagtagatgcgggagaaaccccagaacaggctttaaaacgtgaactggaagaggaaataggcattgttgcgttaaatgcagaactttatgaacgttttcaatttgaatatccaacaaaaatcatttcttttttcttttatctggtaaatgaatggattggtgagccttttgggcgagaggggcaagaaggtttttgggttgagcagcacgcattggatgcaggacagtttccccccgcgaatgcaaaattaattcatcgattactaaatgaaactcataatttcatataaaataaatgtggtttaaagttatattaaaagatttagtatgatttatcacatataactttttaatatactcgccaaaatatttgtattttttgcattattggagtcattatgtctcaacttgccaatccagaactgatgaaagtcgttattttactcgcatctagcgtaacaattgtgccgttatttaaaagactcgggttgggtagcgtgctaggttatttagtggcaggttgtttgattggcccatctgtctttggcatagtgcaagaaccaacagctgtggtacatttagcggaattaggtgtggtaatgtttctttttattatcgggcttgaaatgtatccagaacgcctttgggcaatgcgtaaagctatttttggtagaggtttgttacaagttggattatgtggttgcttactcactttttcgggtatttatttattaggattaacaaaagaagtatcatttatcgctggtatgggtttcacgctttcctctactgctattgtaatgcaatcactagaagaaagggggcttacttctacgtcaaaaggacaacgcgtaatttcgacattaatttttgaagatattgctattgtaccacttttggcttctgtcgcttttcttgctccccattcgaaagaagcgacaccacatactgattgggtatcaattggtatagcattaagtgctgttgtggggttaattgtgactggaaaatggctaatgaacccactatttcgtttaatttctaaagcacgtattcgtgaaatgatgacagcgggcgcattattggtcgttttaggtgctgcattagcaatggaaattggcggactttcaatggcaatgggcgcgtttgttgctggtgtgatgatgtctgaatcagcgtttcgccatcagcttgaagcggatatagaaccatttcgcggcttattactaggattattttttatgggcgtaggaatgtccttagatttgcatttagtgtttaatcattggatcttgctacttggaattgtttttctttatatacttggaaaagccagtgctgtttatattattgcccgaattacccgtcttgatcatcgagaagccataggacgaatgtctttgatggcacacggtggcgaatttgctttcgttcttttttcagctgcagcaactgcggaagtaatcagtaatgaagaacaagcgacattcactgctgcagtgattatttcgatgcttttttcgcctattattgctcaaattgctcgtaaacttatacagcgtacagagcctaaacatcttgatcaacttgatgaaaatgatctagacaccatcgtggatttggaagataacgttttagttattggttttggacgttttagtcaaattgtctgccaaacattattaattcgtggaattagcgtttcagtgattgatcgcaatatcgaaaatatccgtctgccgcaaagtttggttttaaagtttattatggcgatggcattcgattagatgttttacgagccgcaggaattgaaaaggcgaaatgtgtcgtattaggtattaacgatacacaaagaattgaacatattgtcagtcaaatgaaagaggcttatccaaatttaccgattttaacccgaacttatgacagaaaaacaacagttagtttgattaagcaggatgtagattttattgtgcgtgaaacttttgaatcagcaattacacttagtcgagcaacattgatgaaattaggtattgataaaattgaagcggaagaaattattaaggaagtacgaacattggatcaagaacggttaaatgaagaagttttacacggtttttcgaatgaaatagtaaaaaaatattggacaccaagaccatttattaaaccgcatcttgatacaaaagcattaaataaagaaacagaagaaattctaagtgagaaaattgaagaagaaatatcaaatgatcattcataaaattattttttatctataaaaatattaaattttaacttctcgtttaagtatttacttttgagtgatttaaatcacgtaaatttttattttaaggcaataaatgaataataaaattagtgtttatgataaagataatttctttgagctttatcagaaactccgtgcaaatccaattagcctcaatgaaattatcgaaaagcccaccatgctttcattgttgcctaatttaaaagggaagaaattactcgatttaggctgtggtacgggagggcatttacaactttatttagaacgaggggcggctaaagtaattggaactgatctttccgaaaaaatgctcgaacaagctgaaaaagatcttcaaaagtgcggtcaattttcagggcgtttttccttatatcacttaccaatagaaaaattagctgagttaccagaaagtcatttcgatgtgattactagctcttttgcctttcattatattgaaaattttccgacattattatcaacgatccatgacaaactctcgtctaatggcacattaattttctcacaagaacatccgataactacctgccataaagagggagaacgctgggaaaaaaatgataaaaaacagcaagtcgcttatcgtttaaatcattatcgagaagaggggaaacgcaatagaaattggttcaaacaaccttttcaaacctatcatcgaacaacagcaacaattatcaataatttaattcatgcaaggtttcaaatcgagcaaatggaagaacccatgcttgctgaccaaccgcaatggcataatgaatttaaagatttgtcacatcgaccaccattgttatttatcaaagcaagaaaagtggagaaataaacaaaataaactggtttttaaccgcactttatggtataaatcgccccgctgtttttgcctttcaaaagcagttttttaattactaacaacacacacatattaacaaggcttaatcggggtgccaaacggtcgattagctgatatgtggaggctcaaccccaacaaaaggaaaatattatggcacaagtttcaatgcgcgatatgatcaacgcaggcgtacacttcggacaccaaactcgttactggaacccacaaatgaaacctttcatttttggtgctcgtaacggtgttcacatcatcaatcttgaaaaaactttacctttattcaacgaagctttagcggaattaactcgcattgctagcaacaacggtaaagtattattcgttggtacaaaacgtgcagcgtctgaagcagttcaagcagcagcattagattgtcagcaatattacgtaaaccaccgttggttaggtggtatgttgactaactggaaaaccgttcgtcaatcaattaaacgtttaaaagatttagaaacccaatctcaagacggtacttttgataaattaaccaaaaaagaagcgttaatgcgtagccgtgagatggaaaaacttgaattaagccttggcggtatcaaagatatgggcggcttaccagatgcgttattcgttatcggtgcggaccacgaacatatcgcagttaaagaagcaaacaacctaggtattcctgtatttgctatcgttgatactaactcaacaccagctggcgtagatttcgttatccctggtaacgatgatgcgactcgtgctatccaactttacgtttctgcagctgcagcagcggttaaagaaggtcgtggtaacgaagctcaagttgctgaagaattagcagctgacgcagaataatttaagttttgcaataaggcgaagccttaataatcaagcgattaattggcataggggctaaaatttagcccctatatttttatctaaaagtgcggtcaaaataaaccgcattttcgacagaggattttaaaaatggctgaaatcacagcatcattagtaaaagaacttcgtgaccgkactggcgcaggtatgatggaatgtaaaaaagcattagttgaagcaaacggtgatattgagttagcaatcgacaatatgcgtaaatctggtcaagctaaagcagctaaaaaagcaggccgtgttgcagctgaaggtgttatccttgctcgtgtagaaaatggtttcggtgtattagttgaaatgaactgtgaaactgacttcgtagcaaaagatgcaggtttcttaggtttagcaaatgaagtaactgatttcgcagcagcaaacaaaggtaccactatcgaagcattacaagcgcaatttgaagaaaaacgtgctgcattagttgctaaaatcggtgagaacatgaatattcgtcgtgttgcttacctagatggtcaagtaattgcacaatacttacacggtgcaaaaattggcgtattagttgcgggcgaaggttctgctgatgaactgaaaaaagtagcaatgcacgtagctgcatctaaacctgaattcgtgaacccagaagatgtatctgctgaagtggttgaacacgaacgccaaatccaaatcgatattgcgatcaactctggtaaaccaaaagaaatcgcagagaaaatggttgaaggtcgtatgaagaaattcactggtgaagtttcattaacaggtcaagcatttgtaatggatccttctgtatctgtaggggatttcttaaaatcagtaaatacttctgtttctaacttcattcgtttagaagtaggcgaaggtattgagaaaaaagaagaagattttgctgctgaagttgcaaaaatcactggcggtaatgcgtaattctttaaagataacgatatgttaataagcccaacttaagttgggcttatttgttttataggataagctgcttaattaacgggcttaaacttttttagttacgtttagtaaaataaaaaatccacactttaatagtaaacttttaaagtgtggattttgtaataaaacctcagaagaaattaagaaattttcttttctaacgcttttaaacgtttatttattccatcaatacctaacgttagtgctgctgttttacgccattctttattcgtttgcaatggaataccagaggaatatacgccaggctctgtaattgggcgcataaccattcccattccagtaatggttactttatcacaaatttccatatgaccattaatcacacttgcaccaccaattaagcaatagcgaccaacagttaagctacctgccataataacgccacccgcaaccgctgtaccagtgccaatatgaacattatgtgcaatttgacaaaggttatcgataataacgttatcttcaataatcgtggcatctaatgcgcctctatcaatacaggtattcgcaccaatctcaacgttattaccaattattacttgccctacttgtggaattttaatccaacgaccacgatcatttgcataaccaaaaccatcactaccgataactgttcctgattgaattaagcaattagctccaatctcaacgttatggtaaacagtgacattagcccagagttgagtgcctgaacctatcttggtatttttaccaacaaagcaatttgcaccaatgatcacgttatcacctagtacaacaccttcttcaatcactgcgttcgcaccaatagatacattttcgcccaataaaacaccatcaaaaatgaccgcactttttgcgattccttgtgccgcttttggcgtgctatccatatattgcgctaaaattgcgtaagccacataaggatctttaacaataagtaaattgctttctggagaacagtgttcaacatcctcttcagaaacaatcaaaatccctgctttagaatctttcaataatacacgaaattttacgttagaaataaaagtgagttgatttgattgggctttatcgagaggcgcgatattctcaacaacaacatcggtgttaccgcgaacggtagcgccgatttgagttgccaattcttgtaaagaataggatttttgcattatgagaacctattattttttctcttgtgctttttcagaagcagggatagattttaatacttcttcagtaatatctttaccctctaccgcaaatacaattgaatttgcatcaagcacataagtataaccttttgcttttgctaaattatttgtcgcagtttgaatgctatctaataatttaccacgttcttcagcttgacgtttttcattttgagcttggaattcttgaacttttttatcttgttcttgcattaatttttgtaattcagcatcttcagccgcacctaatttattaatttcctgttggcgtttttgaatatcagcttgacgtaagcgaggtgcatctttttctaaagccgcaacttttgcttctacttttttacgagcagcagcaattttatcatcaacttcttttttgcttgctgctaatttctcagctacaggtttaaattcagcatcaagtttatctgctaccgcttggcgatctgggtgatgttgaaaaatataacctgcattaatgaaagcaattttttcttcagcggaagcatagcctgaagcaagtgcaatacctaaagcaagtgcggttacttttgcgatgtttttcatttgataaatatccttaattaaatgatgggtttaatattttctctgcccaattaaattaggcagagaacgttgtttttgagttctgatgaagaaaaaagttcaatttattagaaagaacctccaatactaaattggaactgttcgacatcatcattttcatattttttaattggtttggcataagagaataccaatggcccaataggagattgccattggaatccgacacctgtagaggcgcgaatacggcttgatttgccataatcgggtaagctttttaatacattgttatctaacccactcttatccgatttccacttagtattccaaacacttgccgcatcaacaaatagggaggttcggactgtattttggcttttatcactcacaaacggtgttggtacaataagttctgcactcgcagttgtgattgcattaccaccaatcacatcagaacttatcttcttaaaagtaccattaccattaccatgttctgcataaattgcgttaggtccaatactaccataagcaaaaccacgtaatgaaccgatgccacccgctgtataagtttgatagaacggtaaacgcttgtttccaaaaccatttgcatatcctgcagatgcttttgcagatacaacccagaggtgatctctgtctaatgggtagaaaccctgtacgtctgcacttagtttgtagtatttgttatcagaacctggaatagtaactcgtccaccaagacttgctttaacccctttagttgggaaatagcctctattaaggctgttatagttccaaccaaaagaaaaatcaaagtcatttgttttaatgccattacctttaaatttcattgattgaatatataaattacggttatattctagagcaaagttactaattttattataggtatggcctaatcctacataataggagttatttncatttacagggaaacctaaagtaacattacttccataagtcgtacgcttatagttagaggatgtatcacttttagagttatcgtagttttcaaagaaaacatttccaccaagacttacaccatctttagtaaaatagggctcggtataacccaaattgacactcgtaccataatcatttttcgtaccagctatacttactgccgcccctgttcccaagaaattatcttgtttaacacttgcttgataactaataccactctctgtaccgtaaccaataccaaagttgatactacccgtgttacgttctttgactttatatacgacatccacttcatcattactaccattgataggatcaattcggttttcgactgtttcgaagaaacctgtacgatctaagcgaatttttcctaactcaactaattgtgaattataccaagttccttcttgttggcgcatttcctgacgtaaagtgctatcagcagaaacggtatttccttcaaagcgaagttggcgaacagttaaacgtcgtccagcatcaacaacaagggttatcgctaatgttttatttgcatcatcaaaatcaggtactgaatttaccgttgcgctaccgtaaccgcgttctccaagttttgctttaattgcattttctacatctgcaatgtcactacggcggaaagtatcatttaaatgtaatgctgacagtaaaggttcaagctcggcagacatacctcccagattacctataatgcgtgcactacgaaggtcatactgtaaaccttcatttacatcaatggttacattaacttttgttttttcatcatttagctgaacatccgttttagtgatttgtgctttggcatagccattatttaaataataatcacgaattgactgcaaatctttctcgaattgcgcaccttcaaatttatttccccataatttccaccaagaatcaggttgtaattccatttgttcttgtaatgtactgctactaacagattcgttccccttgaaagttaatgatgccaattttgctttatcatcttcattgatttgaattaaaatttcagcgcgattatttggtagcgtattgacaataggttcaacggttgcgttatagcgacctacacttgcatagtgctcttttacacttttggcaaattcatttaatttttctcgaattaaaacatcgccaactttaaacccgttagcatctaagttttgttttagtgcttcagtgggaataatagagttacctttgattttaacatctgaaatgatcgatttagccacaacgctaacaacaagcacatcgccttcttgatgcgctttcacatcatcgaatcgaccacttacgaataaagagcggacaatattagccacatcattgtcagtcacacgctgaccagcacgaacaggtaaacttgctcggatttgttgttctaagtcaccttgaacaccatccacacgaatatcttttgccacaaaaggtgcggcaaacacagtcgttgtcgtaccgaataataaacttgcgattagaagttttttcatcgattgtatcctatataaattatagacgtaaaaaatcattaaataatgcaaacaccgttaagcttaataacagtgctgcgccaattcgataacagatgctttgcacccgctcagaaacaggttttcctttaacagcttccattgttaaaaaaactaaatgaccgccatctaatactggtaatggaaataaattcataatccctaaatttacactaatcaatgccataaaacttaaaaaatacaccaatccaatatttgctgatgcgccagcaccttttgcaatagaaattggcccacttaaattatttaatgacaaatcgccagtaagtaatttccctaatattttcaaggttaaaagggaaagctgtcctgttttttcaatgcctttttgtaaagattcaagaataccatattttaattcagtacggtattcatccgctaattttgttaaggctgggctaaccccaacaaaccatttgccattttgattacgcactggagttaggactttgtcaaatgtttctccattacgttcaactttaatagaaaaagattcgccttgttcgacctgttttataaaatcttgccaaggaagtgcggttaaattttcttttaaaattttatcaccgatttgtaaaccagctttctcagcgggagaattttgaacaactttagaaagcaccatttcaattttaggacgcataggcataatccctaatgcctcaaaagcactttctttttcaggatcgaatgtccaatttgtaagatttaaagtccgttgttgttcaatattagaattgaaaggagaaaggctaatctcaacattaggctcccccatttttgtggcaagtagcatattgatggtttcccaatcttgagtttcttcgccatcaattgtaagaatttgcgtattgggttcaatgtgggcttgtgctgcgattgagtttggtgttattgattcaatcactggtttaaccgttggcattccataaaggtaaatgacccaataagcaaaaattgcaaaaataaaattagctaaagggcctgcaataattacaaatgaccgttgtaatacgcttttactgtcaaatgcttgtgatttttgctcagcaggaactacttcattacgtccatcaagcatttttacatagccgcctaaaggaatcattgaaaccgcaaattctgtaccatatttgtcaatgcgtttccaaattacttttccaaaaccaatggaaaaacgatggacttttataccgcactttctcgctgcccaaaagtgaccatattcgtgaacggatactaatacagcaatagcaatgataaaagaacctagtgaccacaaaaatgacattaaaaatccttataagacaaagaaatagaaatagctgaaaaaaggtaccgcggcagtcaagctgtcaatgcgatctaatacgccgccgtgacctggaattaattgactgctgtctttaactcctgactcacgtttaaacatactttcagttaaatcgcccaatactgaaattgcaactgtggctacagaaagaatgataaatccagtaatatttcgatcgcctactaaagtattgttagagaaatgaataaagataaaagcaagcactaatgctgtaattaagccaccaatgaccccttcccaacttttacctggcgatactttaggggcaagtttacgtttgccaaaggcgcgtccgctaaaataagcaccagaatcagccgcccaaacaagtataaatacgtaaagtaataaaaataagccgtgataaggatcatgggtatagtgttctaaacgtaaacgtaatacacctgcgacaaatggaatcaacgtagaaaaggcaaataaaagttgtaaaagtggatttttagaccaaaatttagctgatttagggtaactgatcacaagtaacaaagctaaaccccaccagctaacagcatttatcaataaaagctgaagatgttgttcaaacacacgccctgcatctaaatagttgccctcagtatagagccataagaagataaatacgcctaaaaaggtagtcacaaaaaaacgtatcaaaggttgttttaggcgagcaaattgagtccattcccaaatgcctaaaatcgctactgcccctaaagcgagggcaaaataaaaaggtgtgaataaaaatagcgcacataaaactgcagcaattaacacaatagcagataaaactcgttgtttaagcataattttaatccgtttaactattcagtcccgccaaaacggcgatgacgttgttgataacttgcaatcgcgcgattaaattctaattgattaaaatcaggccaaagcacatcggaaaaatataattccgcataggcaatttgccataataaaaagttgcttatgcgctgttctccactggtgcgaattaataaatccacaggtggtgcattttgggttgcaagatgatgttgaaaagtcgagttattaatatctgaaactgacatttcttcttttttaactttttctgcaatttgtttagcggcttgaataatatcccaacaaccgccgtaatttgccgcaatattgagtgtaagtgcggtatttttttctgttaaattttccgcttttttgattttttcttgtaaagtttcactaaaacgagatacatcgcctataattttcagacaaatattatttttatgtaattttttcacttcgcgatccaaggcttgcataaaaagcgacattaacgcgctgatttcttgttctgggcgactccaattttcgctactaaaggcataaagtgtgagtacttccacaccgatttgtcgtgcataagccactgctttgcgtaccgcagtaacgccattggtgtgtccgaaaattcgcattttatttttctgttttgcccaacggccattaccatccataataatggcaacgtgttttggtatatttgtttgatccaactctatcattatttttattattgagagacctctataaatttggtggtaaactatatcataagttatattggcttgctatgaattcctttgttctaatctgttctgcaaaaattgaaaatttattgtaaaaaacaactaaaaaaccaccgcactttttatttctctccctattaatttttgccattttacggtattctatgccacattttctattgtcaaaatgctgcaaaagtgcggttaaaatttaaggtgattttatgcaagaacaatatcgccccgatatgatcgaaccaaaggttcaacaatattgggcagaaaataaagttttcaaagcaatcaaagacgaatctaaagaaaaatattactgtctttctatgttcccatatccttctggccgcctgcatatgggacatgtacgtaactatactattggtgatgtcatttctcgttatcaacgcatgttaggtaaaaacgtgttgcaaccctttggttgggatgctttcggcttaccagcagaaggtgccgcaatcaaaaacaaaactgcgcctgctaaatggacgtacgaaaacattgcctacatgaaaaaacaacttcagcttttaggctttggtttcgactgggatcgcgaaatcgcaacctgtaaaccagaatactacaaatgggaacaatggttcttcacggagctttataaaaaaggcttagtgtacaaaaaaacctcaaccgtaaactggtgcccgaatgatgaaacagtactcgcaaacgagcaagtacacgaaggttgttgctggcgttgtgatacaccagtggaacaaaaagaaatcccacaatggtttatcaaaattactgactatgcagagcaattattaggtggtttagatacccttccacaatggcctgacatggtaaaaaccatgcaacgtaactggattggtcgctctgaaggggtagaaattacctttgatgttgcaaataccaacgaaaaagtggcggtttacaccacgcgtccagataccttttacggcgtgagttatttaggtattgcagcggcacatccattagcaagtttagcagctcaaaacaattccgaattagccgcctttatccaagaagcgaaaaacgccaaagtggcagaagctgatcttgcgacaatggagaaaaaaggaatggcaacgggattatttgctattcatccattgacgggggataaattaccgatttgggttgcgaatttcgtattaatgcactacggcactggcgcagtaatggcggttcctgctcatgaccaacgtgactttgaatttgctcaaaaatacagtttgccaattaaacaagtgatcgcaccgcttgcagatgaagaaattgatttaaccaaacaagctttcgttgaacacggtaaattagtgaactcagacgagtttgatggtaaaaattttgatggtgctttcaacggcattgcagataaattagaaaaattaggtgttggaaaacgtcaagttaattaccgtttacgtgactggggcgtttctcgccaacgttattggggtgcaccaattccgatgctaacccttgaaaatggcgatgtagtacctgcaccaatggaagatttacctattattctacctgaagatgtggtaatggatggcgtaaaaagtccaattaacgctgatcctaattgggcaaaaacaacctttaacgacgcaccagcgttaaaagaaacggatacctttgatacctttatggaatcctcttggtattacgcgcgctacacttgtccacaatatcaaaatggcatgcttgatgcggaagaagcaaactattggttacctgtggatcaatatatcggtggtattgaacatgctacgatgcatttactctacttccgcttcttccacaaattattgcgtgatgcaggatttgtaactagtgaggaaccagccgataaattattatgtcaaggtatggtgcttgcagatgccttctactacacaagtccaaccaatgagcgtatttgggtaagtccaacacaggtaactcttgaacgtgatgaaaaaggcagaattattaaagcgaccgatcctgaagggcgtgaattagtccacagtggcatgaccaaaatgtcgaaatccaaaaataacggtattgacccacaagaaatggtagaaaaatatggtgccgatactgttcgcctctttatgatgtttgcctctccagcagaaatgaccttggaatggcaagaatcaggcgtagaaggtgcgaaacgtttcttaggacgcgtttggaatttggtatatcaatatcaacaaaatccagcaaaaactagcctagatttgaccgcactttccgcagaacagaaagtgcttcgtcgtgaagttcataaaaccattgcgaaagtgagcgatgatattggtcgtcgtcaaacatttaatactgcgattgctgcagtgatggaattgatgaataaactgactaaggcatcgcttgatagcgagcaagatcgtgcagttatggcggaggcattaagtgcagttgttcgtatgctttatccaattacgccacatatctgttttgaattatggcaagctcttggcaatgaaagtgctattgatactgcagaatgggtaaaagccgatgaagccgcaatggtagaagatgaaaaactgattgttgtgcaagtaaatggcaaggttcgtggcaaagttactgttgcgacagatgcagatgaagacacagtcaaaacgattgcttttgcggatgaaaatgtgaagaaatttattgataatcaacacattgtcaaagtgatttatgtcgtaggtaaattattaaacgtggtagtgaaaccataatacatagggtgtgtggatttaaaattcacgcaccattttttataggtatgtgaaatatttacattttacacgtcctacaataaaggtaatttttatgatcaactcaatcaagactttactgcttatcgcaacattagcaattctttctgcttgcggttggcattttcaacagtcggttactatgccaagtgaatggcgaacattagcccttgaaagtgatgactcttataatgattttactgttattatgcgtcgcaaattgcaggaaaatcaggttaatgtcgtcaatttagaacaaaatattcccattttacgtattaataaacagattacttcagatcaagttgcgtctatttttaagcacggacgtgaggcagaaaaacttttaatgttggaagtagaagccactttccgccttgctaatggcgaaagctatccaatcaatgcgaaagtaaaccgtactttctttgataatgcacgtgcagcattagccaaatcagaagaacgagaggtaatttggaatgatatgcgcgagcaagtagcgcgtcaattaatcgtaaaaataattgcgttacaaaatcaaataaaaaggaaataatgaaccgcatttttccagagcaactaaatcatcatcttgcgcaaggcttggctagagtttatctcttgcaagggcaagatcctttattacttagtgaaactgaggatactatttgtcaagtggcaaacctgcaaggttttgatgaaaaaaatactattcaggttgatagccaaactgattgggcgcaacttatagaatcttgtcaatctataggattgttttttagtaaacaaatactaagcttgaatttacctgaaaatttcaccgcacttttgcagaaaaatctgcaagaacttatatccgtattgcataaagatgtcttgcttattttacaggtagcaaaattggctaaagggattgaaaagcaaacgtggtttattacacttaatcaatatgaaccaaatacaatactgataaattgtcaaacaccgacggtagaaaacttaccacgttgggtaaaaaatcgtaccaaagcaatgggattagacgctgacaacgaagcaatccaacaactttgttatagttatgaaaataacctgctcgcactcaaacaagctctgcagcttttagatttgctctatcctgaccataaacttaactacaatcgtgttattagcgtggtggaacaatcctcaatttttacaccatttcaatggattgatgcgttgcttgttggaaaggcaaatcgtgctaaacgtattttaaaaggtttacaagctgaagatgtgcaacctgttattttattacgcacactacagcgagaattatttacgttgcttgaactcacaaaaccacagcaacgtattgtgacaacggaaaaacttccaattcaacaaattaagactgaatttgaccgtctaaaaatctggcaaaatcgccgaccgctctttttaagtgcgattcaacgtttaacttaccagactctctacgaaattatccaagaactcgctaatattgaacgccttgctaaacaagaatttagtgatgaagtgtggatcaaactcgctgatttatctgtaaaaatttgtttgtagtcacaaggcaaataaaatagacaatattgaaataagatttttgataaaaaagaaatttttttgctggaaaaatggtcccccctaccggacttgaaccagtgaccaagcgattatgagtcgcctgctctaaccgactgagctaaggggggaaagtgcggtaattatagagaaataatcacttgaagtctataaaagaagggatgattgacgaaaaattaaccatccctttttacattattgaagcactgaaatatcagctacttgtaagaataacccttgtaacgtatttaaaatcgctaatcggttttgacgtagtgctggatcttcagcatttaccatcacgttatcaaagaaactgtctactggcgcacgtaagtttgctaatttatccaatactgtcgtgtaatcgccttgtgcgataagcggttgtacttcagtgcgtaatgcaagcaccgcttcagcaagggctttttctgctggctctacgcaagcggttaaattgatctcgccaattgccgcacctgctttcgctaagatgttgctgacacgtttgtttgctgctgctaacgcttccgctgaatctaaagtacggaagtgtgaaaccgcacgcacgcgcgcatcaaagtctgctgggcgagttggacgacgtgccaataccgcttgaatcacatccaccgcaatgccttcatcttgataccatgcacggaaacgaccgagcatgaagtccaccacatcagcaaccacattttgattcgtgagtttatcaccgaaaagtgcggctgattttttcactaaatcttctaaatcaagtggtaagtttttctctacgataatacgtaacgcacctaatgccgcacgacgtaatgcaaatgggtctgcgctaccttttggtgcttggccgatgccgaagatacccgttaaagtgtcaaatttatccgctaaagcgaccgcacttgcaacgagagattttggtaattcatcaccagcaaagcgtggcatatattgttcgtttaacgccaccgctacttcttcatcttcaccgtcatgacgagcgtagtgcatacccattacgccttgcgtatcagtgaattcaaataccatgttggtcatcaaatcacattttgacagtaaacccgcacgttttgctttcgcttcgtctgcgccgatttgttttgcaatttcgcctgcaagttgctcaatgcgatcagttttatctttcaatgtacccaattgttgctggaacaacacggtttctaaacgtggtaaacgatcaaccagtttttgttttaagtcggttttgaagaagaattccgcatcggttaaacgtggacgaaccactttttcattcccttcgataatcgcggttggatcttctgggttgatgttcgagacaaaaataaagtgcggtaataatttgccgtctttgtcataaattgggaaatatttttggtctcctttcatggtgtaaaccaaggcttccgcaggcactgctaagaaatgttcttcaaattttgctgctaaaacatttggatattccaccaaggaagtgacttcttcaagcaagctttcttcaatatcagctacgccgccaagtgcggtcgcttttgcttgagattttgcaagaatttctgctttacgctcgttgaagtccgccaccacagaacctttttcacgcaataattgcggatattggtctgcatgttgaatgtaaaattctttctcgcctaagaaacggtgaccgcgaatggtgcgagcacttgccacacctaaaatttcgccttcaattaactcatcgcctaacaacatagtcacagtgtgaactgggcgaataaactgcacggttttatctgcccaacgcattggttttggaattggcaatttcgctaacgcatttgccacaatatcgttaagtaagtttttggtcggctgaccttcaattttcgcacgatgaatgagccattcgcctttatcagttgcaatgcgttctgcttgctcaacggtaataccacaaccacgtgcccagccttcagccgcttttgttggtttaccttccgcatcaaaggctgctgacactgcaggcccgcgtttttcgatttctttgctcggttgctgtgtggctaagttcaacactttcaccgccaaacgacgcggcgccgcaaaccattcgattttgtcgaatgataaacctgcttgattcaattccgcctcaacgttatccgcaaaagaggttgctaatgttttgagagcttttggtggcagctcttccgtgccgatttctacaaggaagttttgggttgtcattttgtttctcttatttaaaaattctgtagatttaaantcttattttctcgttatcatttctgccaaatcgcccctacccctctttgctaaagaggggattggatctttggagagttaaatatttatgttctactttaacgttttttgaaagcagataatttaatctctattgaaattaaaatgtaaatgagccagttactatcaatttattcaagaattcccctctttagcaaagaggggtaggggagatttactcgcttcgctcgcacttcgtgccgttgctaaagcaacgttcaaacgcaagcgtttgtggcagaggttaatccaacctcatactcaatcagtccttacattctctaaaaacaaataaatctgctctactaccgcttcaatttcacgcatgacttcatcattgctaaaccgcatcactgtaaaaccaagtgaatttaattctgcatctcgcaatgcatctttttcctgataatcaggtttatagtgctgactaccatctaattcaataatcagctttgtctttgcacaataaaaatcaacgatataacttaaaagtggcttttgtcgattaaatcgaaatcctaataattgatctcgattgatgcgttgccatagctttctttctgtatccgtttgatccgctcgcagtttctgcgaattcagctttaagtatttttcatagggttgcatgaaaactgctgttctatctttcccaaaacttaaaaaattacttttaactttgataggtctaaaacaacatcgccatttggtaataacaatgcaggaatgcctaaatagccatttgctttcgagttatcaaattctgcactgctatcgcgtaaacgaatgaattgtttgagattaggtaatgaagtcataatttctacttcatcgtaatccacacctaagcgatccaactccgcgacaaatggcgcggtatctgggcatgtttctgcataaaaaagaatgggtttgctcattttgctctcctaaagtgcggtcaaatttcaccgcacttttttgaattacctttaaatgttattttttacaacctgggaaacctaaggcttcacggcttgcataataagcttccgccacgcctttagttaaggctcgaatgcgtaaaatatagcgttggcgttcggtcactgaaattgctttacgtgcatctaataagttgaagctgtgtgctgctttcaaaatacgttcataagctggcaatggtaacggtttttctaaagctaataactcttgtgcttctttttcgtattgatcgaagcagtagaataagaaatctgtgtttgcgtgttcaaagttataggttgattgctcgacttcgttttgatggaatacatcaccgtaagtggttttaccaagcgggccatcagaccaaactaagtcatatacagaatctacgccttgaatgtacatggctaaacgctctaaaccataagttacttcgcctgttacaggtttacattctaagccacccacttgttggaaataggtaaactgggtcacttccataccgtttaaccatacttcccagcccaagccccatgcacctaaggttgggttttcccagttatcttctacgaaacgaatgtcgtttttggtcggatcgaagccgagcatttcaagcgagcctaaataaagttcttgaatattatctggagaaggtttgattaccacttggaattggtagtagtgttgtaaacggtttgggttttcaccataacgaccatcggtcggacgacgtgaaggttgcacataagcaaatgccattggctctgggcctaatgcgcgcaatgcggtcattgggtgagaagtacctgcgcccacttccatatcaaaaggttgcacaatggtgcagccttggtttgcccaatattcttgcagggctaaaatcataccttggaatgtttttacgttaaattttgtactcataatcgttgatctaatgtgattaaaaatgttggtattatacttgaatccgtaaaagggataaaggcgaaaaatgcggttgaaaatcaggctttataaagatatatcaagtaagtaattttgaatatttaggtagattttaagttttattttagtatagttttttttgattaatttaatagatttcgattgtttaaacctttctatatgatacgcaagaaattcatttcaacctaactaaatttattaactttacaaggagtctacaatgagttctcaatgtcctttctcgcacttagctgcgacaaacttaacaatgggtaacggtgcacccgttgctgataaccaaaacagcttaacagctggtccgcgtggtccattacttgcacaagatttatggcttaacgaaaaattagctgatttcgtacgtgaagtgatcccagagcgtcgtatgcacgctaaaggttctggcgcatttggtacttttactgtgacacacgacattactaaatatactcgtgcaaaaatttttagtgaagtgggtaaaaaaacggaaatgttcgcacgttttaccaccgtggcaggcgaacgtggtgcagcagatgctgagcgtgatattcgtggttttgcattaaaattctatactgaagaaggtaactgggatttagtaggtaacaatacgccagtattcttcttacgtgatccacgtaaattcccagatttaaataaagcagtaaaacgtgatcctcgcactaatatgcgttcagcaactaataactgggatttctggacattattaccagaagcattacaccaagtcactgttgtaatgagtgatcgtggtattccagcaagttatcgtcatatgcacggtttcggttctcacacttatagtttctggaacgaagcgggcgaacgtttttgggtaaaattccacttccgtactcaacaaggcattaaaaatttaacagatgctgaagcagccgaaattattgcaaatgaccgtgaaagccatcaacgtgatttatatgaagcgattgaacgtggcgatttccctaaatggacattatttgtacaaattatgccggaagcagatgcggaaaaagtgccttatcacccattcgacttaactaaagtatggtcgaaaaaagactatccattaattgaagtcggcgagtttgaattaaaccgtaacccagaaaacttcttcgctgatgtagaacaatctgcgtttgcaccaagtaacttggttccgggtattggcgcaagccctgacagaatgttacaagcccgtttatttaactatgcggatgcacaacgttaccgtttaggtgtgaactaccgtcaaattccagtaaaccgtccacgttgccctgttcatagcaaccaacgtgatggtcaaggtcgtgtagatggtaactacggtagcttgccacactacgagccaaacagcttcagccaatggcaacaacaaccagactttgctgaaccaccacttcgtatcaacggagatgcagcacactgggattatcgtaacgatgataacgattacttcagccaacctcgtgcattatttaacttaatgaatgcagagcaaaaacaatcattattcaacaacacggcagcagcaatgggcgatgcacctgatttcatcaaatatcgtcatattcgtaactgccactggtgtgatgccgcatacggtgaaggcgttgcgaaagcattaggtttaaccgttgaagatgcattaaaagctcgtgatactgatcctgcattaggtcaaggtggattgttataatctttcgagttaattattttaaataaataatagtagtaatgaatctgcacctaaaagttaggctaaggtttaactgattagggtgcagatttttttcaatgaaatattactaattcattacataatacttgaacgattttgtaatcgttcaaaaatttgaatgtaaaaataacctataatagcttccattttttatggtaaatattgtatttaagtaatgctaaatatatatcatggcacaaaataatgaggtataaaatggctatcattacccgtcactgcagtaaaatcttcacgtaagcccattccacaagccacatcacccacaacccaagagccgataattggatacattccatcaaaacttggcaattcaaatttttgttgataaacataacctgaattaccataaaacgttgagtgttcgcttcctttcgctgcaaattctacaccattatttttctcataatagaaaacattggcaccttctcgacctaacaatggttttttcacccacatcgataaatcttttggtagttcgaaaggcgtaaaataagcaggcaataaatgcggatgattaggataacgcgcccaaagttttgccaatagtgctttattacttaacaacattttccacgctggttcaataaatcgtgtttcagccgttgtaatatggcgagcaaactcagcgtggcttagccattctagcggatacaatttaaataacatttcaataggttgatcatttaaatctacaaatttttttgtttcgctgttatagccaatatcttccaccgctaattgatgaatattccaacctgcgttataagccacatcagctaaataatccacattgccccaatcttcacggccagcatcctgcatggcactcaaatggaaatctgttttgccactttgttgttttaaaaattggaaatgttttattaattcttcatgaatccagttaaattgatcacgatgtttcaagccctcaatttgctccaaccactgccattggacaaccgctgcctccaacaaagatgttggtgtatcggcgttatattcaaacatttttaggttgttgccatcatagccaaaatcaaagcgtccatataaataaggttcttgattacgccaagaggtttcaataagctgtttttgcaactccgtaaaatgataattttcataatcgccttttttaatttcatccgccgcaaaatctaaacacattgaatgcaattcattagttgtatcctcaatgcgatcaatttccgctaaggtaaattcataggcgacattatcagaccaataatgagatccatcactggaaggcaagttataataatcaaatccaacattaagtagctgttgcaccatatctggtcgagtaggaaacccagttacacgtttcatttagcccccactgctacgatgagttttatttgggctactaaaaccaccacgagatacaggtttgctattcatgcttcctgcatttcctttcacgagcattggttttccaacagagcgatttgtttgcggttgcacaacttgccctgttggtgtggtgacagctcgatttccaggatgatagcttgggccaaggaaactactaattgcacgagccgccatataccctataacgccaccagcaattgcggctcctaaagaaggatcggtactttcagcttttgtagttgattcagctctgttctcgctttgattagcttgtgcattattttcagctggattttttaccgcactttctgcattaccattatcacgaatatttaaacccagcccctgctgttgtgtagttgcagttttctgagtactttcagtatttttatctgcctcacaaagctcaatttttttccaatccgctaaacaatcgtctaaagactgatatacatcgcgttgtacttgctcttctgaacagcctcctaataaggccacaatagataaactaactaaaatctgattttctttttcattgttctcaatttttatcgaatggtttttacgcctagccattgctcggcctgtttattagtaatttcttcacgagtccacatgctcattaaatctggttgtggatatttattgctgttatagccgactaaacgggcaaaatcaaatacagcatgaggatagccattaataagcaataaggctacataaccactctcatcccaacaaatttcaagtttgcgtgcttcatgatgattagaggttgaatcaacattatacacgtgcaacatatccactatcggttgagcattttgacgcatatcaagcgcataaaaatagccagtttccccgtcatcttcaaacattacggcaaaatgctcaaatactgtcgaatgtgttcccacttgctttggcgttcctaaaaagagctcgtcctctaaagttaaatgtaacattctctttcctttaaatattagatataaaaacaccgcacttttatacaaagtgcggtgagatttcacagtaaattcagcgtgaattacgcttgacctttaaccgcttttaagcctgggaatgctgctggagtaccagcgcgttctaatgcttcttcgatacggattaattggttgtatttcgcaatacggtcagaacggctcatagaaccagttttgatttgacctgctgctgtacccaccgctaaatcagcgatagttgcatcttcagtttcgcctgaacggtgagagattacagcggtgtaacctgcatctttcgccattttaattgctgctaaagtttcagttaaagaaccgatttgattgaatttgattaagatagagtttgcgatacctttttcgataccttcttttaagattttggtgttagtgacgaataaatcatcgcccactaattgaacgcggtcgcctaacactttagtttggtatgcaaaaccttcccagtctgactcatcttgaccatcttcgatagacacgattgggtactctttgcataattcttctaagtagtgagtgaattcttgagaagtgaatgatttaccttcacctttcatttcgtacataccattttctttgttatagaactcagaagatgcgcagtccatcgctaaagtaacgtctttacctaatacgtaacctgctttttctactgcttctttgatacaggctaaagcgtctgcgttagaggctaagtttggtgcgaaaccaccttcgtcaccaactgcagtgctcatgcctttagcttttaatactttcgccaagttgtggaatacttcagcaccgatacgaagtgcttcacgtaatgttttcgcaccaactggttgaatcatgaattcttggatatcaacgttgttatctgcatgttcgccaccgttaatgatgttcatcattggtaatggcatagaataaacaccagcagtgccatttaattctgcaatgtaagcgtaaagtggtaaacctttagatgctgcagctgcttttgcgtttgctaaagataccgccaagattgcatttgcaccaaagttagatttgttttcggttccgtctaaatcgatcatgatttggtcgatttcagcttggtttgttgcatctttaccaacgatagcttgtgcaatttcgttgttcactgccgccacagcttttaatacgcctttacctaagaaacgagatttgtcgccgtcacgtaattctaatgcttcacgagaaccagttgatgcaccagatggagctgctgctaaaccnacaaaaccaccktcaagatgaacttcagcttcaacagttggattaccgcgtgagtcgatgatttcgcgaccaatcactttaacgatttttgccatttttattttcctcaattaagttaattaaaacgggttaggcgagcctaaaacaggcgatatgataaagctattttragattttttcttgtaaaaaatgcgtatgctttgatctttatctatttattgtcttgagatacttagagcacaagcataagccgagctccacgcccattggaagttataaccaccgagccagcccgtcacatccaatacttcaccaataaaatataaaccgctgacttggttgctttccattgttttagaagaaattactttagtatccactccgcccattgtgacttcagccgtacgatagccctctgtgccatttggagtaaattcccagtgatgaataaaatccaccagattttttacccgcactttgctgatgttagcgataacttcatcttgcacaatgccttgttcaatccaaagttcgaccaattttttcggcaataatcgaaccaagatggttttcaacatttgttttggagaagattgttttgcttgattaatttcctcttccacattgtggttcggtaataaatcgatttccactgactcagtgggctgccaataattagaaatttgtaacaccgcaggcctgaaataccacgatgagtaaacaaaagctggttgtaaaaagattttccgcacagtgccgtgatagtgacaggcaagctaatacctgaaagtgcggttaaaaatttatctgtttctcgataagtaaaaggcactaaactcgcacgaggcggaataacaggaatgccaaattgttccgcaatttgataaccaaatggcgttgcgccaagcccaggcatagaaagcccacctgtcgcaacaatcaaatttttacattgccattgggttgaatttacctgtaaaacaaaccgcactttttcatcattttgaatccgttcaacttgagaaacttcgctacgcaataaaatcttagcaccatatttatcgcattcagatttcagcatttcaacgatttgttctgcaccctcatcgcaaaataattgccccaattccttttcgtgataagtaatcccttgctccgccactaaagaaataaaatcccagttggtataacgagctagtgccgatttgacgaaatgaggattttgcgaaagataatgagctggcgtaacctctaaattggtgaaattacaaaacccaccgcccgacatcaaaatcttacgtccgatttttttgccgttgtcgaaaactgttaccgacttgcctagcttagccaattgtgcggcacaaaataatcctgccgcacccgcaccaataataatattttcagaatattggctcacggattttgtcctttttcaccacgttgtaaaaaatccaacatcttcattcgttgaataactgaacgacgatccactgccgcattacctgaatctaataactgctgtaaatacataccggcttgttgatattggcgattttctaaggcaattgtcgccaacaaagaaagactagatacttcatttttatcttttgccaaagcttcattcaaaagttgttcgactttttgggtcatttgctggcctgcttgataataaagtgcggtggctgccaagcctaaaatattaggtttacttcccgacaatttttccgcattagaataagccacaagcgcgctatcaaattcattattctgcacataggcttccccaagttgaagccaagtttccgcattattcggatcagttcgcagtttattttggagcttctcaatcacattttcatttttgtgttcatcattcatttcaacattttgattatgttgctcaatcatcgattgctcgccttgttgaacacgactaaaacgatcaagggaaaaataataagtagctggaatagcgatgagtaaagtaaaaagcacaaaataaattttgctattcacttttcccttagaaagtttacttggctccccttgcttgcggggggagctgccaaaggttgaggggagggaaattatttcatcattctctagttgttgtgcaaccactttttctgaaaactgttttttcctatttgagaaataaagcaatactgcagctaaaattaaaagggcgactggcaataaccataacaacgccgtattccatttgaatggcggtttgtaattcamaaaatcaccaaatctagccgtcattttatcgataatttgctgattgcttttgccctcatccaccattttgtacacttcaagacgcaagtcataagcaattggagaattagattccaccaaattttggttctgacattgtggacagcgtaaagattttgccaactctacggcgcgagtacgatcatcttgattttgaaattgataggtatccaccatttccgcttgagtaaacaaggaaaatgcgaataaaagtgcggttgcaaaaaagactgttttttgaacctgaataaaaccgcgagtaaaaatatctaatatacttttcatttgttcttcaatgcttcaattttcggcaaaaataccgtttgccaagtttctttatccaataaaccagaatggcgataacgaatcacaccattttcatccacaagataagtttctggcgcgccatccacgcctaattttaatcccaattccccatgactatcatcaatggttaagatgaacggattgcccattcgcttaagcattttaatgccattttgccgattatcgcgataatccacgcccacaataggcaacgtttttgcaatctcaattaacagaggatgttcttctttgcaataaccacaccaacttccccaaacatttaataaaaatggctgtttaggaaactctttcgggcttacgatttgtgatggctcatgtaaattagcctgataaaactctggaacaggtttatcaattaaagccgacgcaatttttttcggatcttgatttaaccctgcaattaataatatacacacgcctaaaagcacaaagagcggtgtaaaaaagataagttttttgttcattatttttcctgttttctgcgtaatccgaaaacgctaaaaagtgcgccaaaggccattaaaataccgcccgcccaaagccaacgaatcagtggtttataatgtaagcggaaagtaaattcccctttgccaagagaatcgcccatcacaatatataaatcgccccaaaaaccaccatcaagccccacttcactcattgtcattgttcgtacatcgtaataacggcgttctgggataatttctgcataaggtttaccatttttagttacgtcaaaaaaggcgacttctgccgtaaagtttggcccaatttcattagaaaattggcgataatgaaattcatattgccctaacgtttgactttgttgcggtgctaaacgcacaccaatttcactgccaaaatacccactcatcaccgcaccaatagtcacaatcgccacgccacagtgtgctaaaatcatcccaaattgagacaagcgaatttgtcgccaattttgccataacgtgacgaataaaagccaaatcgcaagagttaataacacaaaggcgaaagcatggaaatgtaatgcagaattatttcgtagctgttgccaaatcattaggcctgcaagaattaaagacggaataagcaaccacccacaacgtatcaataatgtgcgatcaaattgccccttacgtatgctaagcacaattaccattaagattaaaatcgccgtaataatggggaagnaaatactattaaaataaggacttcccaccgaaattgagccccaattcatcgcttggaataacatcgggtaaaaggtacctaaaaaggtagaaaccgtcgcaatggtcagcaaaatattcagtaataaaatgccacccgatttagaaatgaactgaaatttcaccgcactttctgatgaacttcccgctcgtaaagcgaataaaccaaaggctaacgctgtcaaaacaaagaaaattaataacaacacataaccgcgcgtgttatccaatgcaaaagcatgcacagaagtgagtgcgccagaacgaacaataaacgtgcctaatacgctaaaggcaaaagcaagcagagaaaaaagcgttgtccaataactaaatacgccttgtttttccgtcgccattaaactgtgtaataatgccaaaccaagcaaccaaggcattaaagacgcattttctacgggatcccagaaccaccaaccgccccagccaagttcgtaataagcccaccaagcaccaagcacaatgccaatggttaaaaataaccaagaaaccaacacccatccacgcattgagcgggcaatttgtcgtgcagattggttataaatcaacgcactcaaactcattgcaaaatttaccgcaaagcccacatagccaacatatagtaaaggtggatggaaaattaatcccacatcttgcaacattggattgagatcgcgcccttctgcgggtgctgggaaaatgcgtccaaatggattggaataaaataaaataaacaccgcaaaaccaaagcaaatcaatcccaataaagataaagattgagcagaaaaagtgcggtcattttttcgattaaaaaaagcaaaagcagcaagccataaactcaatgaaaataaccaaaacaacattgaaccttcatgtcctccccaagtggcagccactttaaaaaatgtaggtaattgggaattagaatgtgccgctacatattcaagggtgaaatcatccaccgcaaaagaataagcaagcaaaccaattgataacgtcgtcgcaagggtaaaaatataactaagcggccaagcagcattaattaaagtcggattttttttgaataacccaaattgaggcactaacgcaaggaaaaacgcgctagctgttgcgagtaaaagaaggaaaaagccaagttctggaagcataatgtcgtcgtttttttcgttgatgcgcagataaagtcgctaatcaagtatgtttcattaataaaattaaaaatagcaccttgataggtgctattgtgcttataaaaattaatgattaaattcagcacctaaacaagggcgaattttatttaacatttctttaattacgcgtgatggtgcagcaatgatattgccactgcgtaagtagtgttaccagcatcaaaatcgcaaactaaaccacccgcttcacgcacgattaaatcgccagcagcacaatcccatgcttttaagcccatttcaaaataaccatcaatacggtttgacgccacatagcataaatccaatgcggcagaaccagtacgacggaaatccgcagcatcttcaattaaggcattcatcattgcaaattgagctggcattaattttggttgtttgaatgggaaaccagtggctaaaattgaaccttgaatttcacgtttactatctacacgtaaacgtacttcatttaattttgcaccttcgccacgcacagcggtaaataattcattacggattggatcgtaaacaaccccgacttcagtgcgattttttacacgaactgcgatagacacagaaaagtggggaagccctgtcataaaattacgagtaccatctagcggatcaataatccattgtacatcgctatctttgccttcaattgcgcctgtttcttccgtaataattgtgtgatcaggataagatttacgaataacttcaatgatttctgcttcagacgctttatcaacgtttgttacataatcattaatacctttttgtgtgctttcgatagcatcacggcgttcataatttttagcaatcacattgcccgcttttcgtgccgcacgaattgcgatatttaacattggattcatatttccaccagcttttaaagaacagaaaaattccgtgccattatagcgagatttgccaaaataactagttgaaaatcataaaacagtggtttttataggttttcagaaaaactttgcgatacagatcgcnaaaatcagatcaagtgatttttctacccattcatttatggttaaagtgcggtggaaaattggagcgttttatgcagaaaggtatgacattagtggaattattgattgggttagccattatcagtattgcgctgaattttgcagtaccattatggaaaaccgattcacctaaaacgattttagccaaagagcaacatcgcctgtatttatttctacgccaaattcaggctcgggcagaaaattcatcggaagtgtggtttttacttatcaatcgtaatcttgcgacacagcaatggtgcttaacggcacaagtaaaaaataaccaaacttgtgattgtttaaatccgataaattgcccgaaagaggtttatgctcatttttactacccttattttcctaacaaaacgatgattcaaagtcatcatatttatccaaaagaaatcacgagatttgatggcattcgtaatactattgttactcgttgctttattttgcaagctgaaaatgaacgtacgttattttnatttttcaatgttggcagtattcgtgtgaaaactaatcaatttgatagtgcttgtaattaatgatgaaagtattattaaaagggcaaaccctattagcactgatgatttcactgtctttgtcgtctttattattgctaagcatttcgcatttttatgtgcaaatacaaacgcaaaatcaacacatgttattacatttaaaattacaagctgaattacaacgaacattacagttaataggtaaagatcttcgccgattaggatttcgagcattaaatgcaaaactgacggaaagcaatttatctttatttgaattagatgaacaaggcacagctatttttattagccaagaagataatgcgccacctaatagctgcgtgttgttcttttatgatttaaataaaaatgggtgtattggcaaaggttcgccgaaaacctgtatgaaaaaaggtaaaaatacatctaaaagtagtactgaagaattattcggctataaagtgagtaacaaaatgataaaaactaaactgacttatcaaagtgttattcctactaattgcacggcagaaacttgtaaacgtgcttttcaacaaaccgcttgtaacgctggtggtggatgggcagatttattagataacaacgaatatgaaatcactaggttacaatttaattggttaattgaaggcaaaggattagaaatcaagctaaaaggaaatttaaaacaaaccccaaatatcagttatgaaacatcccttgttgttgtgctctggaatcaaaaataatgactatacaaaaaggcattatcacgctgactattctgattttwatttcaggtttattaactgcgtttttattgttggatgacagccatttaagttttttncgtgcgcaacaaaatcaacgaaaacactatgtggaaagaacattacaactgcaaaaaatgaccgcgacgaaaaaacaaactgcctgccttgatttacccttaaataataatgaaagtgtgaagcaaatcagcatcgcccttgagggttccaccgatgcaattcaatattttctttggtgtgaaagaatgagcctatttaaaaaatcgcctaaaaagggagataatcaaggtgcattgaaagattttgtgactgacgaaaaacttgcctattttcgaccgcacttttcttccccgcccagaattttaaacgcgaataaaatgcctaaactttattggttttcagattcacaagcagaagttgaaattaatggcaccgtatctgccgtattaattgcagagggcgatttaaaattgactggcaaagggaggattagtggtgcagtgattaccagcgggaatttaactttagatggcgtaactttagcttatgggaaaaagacggtggttgctttagtgcaacaatatagtcagtggcagttagcagaaaaaagttggagtgattttaatgttcaggatgaataaaggaatgtcttttattacattgttattttctttagctttatttagcgttttatttcttgtttttaatcaatggacggcaagccaaagaaaaagtacggtgaaaacttatcaagattttcaggcaatacaggttgcggagaatcaggctcaacgccaatttttagggttagcttgtgaacaattgatacaacaaaatggcttaacttttcgtattcaatgtgaaaatgaacgtattattgtgcgttatcctacgagtgaaattttgataaaaactcagtaaaatggcgttgttttttctaggttaaatcatcaaaaggtcgccattgtgttcattgtttattattccaatcagcttgaaaaacaaaaagaaattctttcttccctattcaaatctttaccgcctgaagatccttttcaacaagatattatcttggtacaaagccctaatatggcgcaatggctacaaattgaacttgccaaagaaacaggtatttcagcaaacctaaaatttcctatgccagccagttttatttggcaactttatgcacaaaatttacctgcaacggcattagagaacccttttgataaagattcaatgatgtggcgtttaatgcgcttaatcccaatttttcttgagaaagaaaatttttcgcctctacgtaattatttatcatcttcgccacattctgaacaatataaactttatcaactcagcagtaaaatagccgacttatttgaccaatatttagtttatcgacctgaatggatttttgcttgggaaaaaggcgaagatgaacaaatcactgatcaaatacaaaaacaacaacctaacctaaacgcaactttgtttgcgcaaattcaaggcaatacaaaatggcaaggtgagttatggcgtgcgttggtcgtcgatgttaaatcagatgttaatgaagccacccatcgagcagctttgcataatcaattcttagccttgcttgccgataaaaaagcaccgaaaaaattaccttcacgcatatttatttttggtattcctgcgcttccaactgcttatctcaatattttgcaagcgatatcctctgaagtggatattcatttattttttaataatccttgccaagaatattggggggatattagtgatttacgccttgattatttgcgttctcgtcagcgttatcaattcaataaacaagatgaaaatcaaccgctcttttccgaggatcaactttctcaactagaaaacgctcagtttgacgtcacttatcaaaaagaaaaccttcaactaggcaatccattactggcggcttggggaaaaatgggacgagattttctctatatattggtgagagatgaagaacatattccaacttatcccgtcaatgcctatcaagaaattgagtcaaacagtttactcggacaattacagtctcaaattctgcatttagaaaataaaccgttaaatatcgcaaaaaatgaccgcactttaaccctacattcttgccacagtgctatgcgagaagtggaagtattgcacgactatttactggatttattcaatcaagatcctagtcttacgccaaaagatgtggttgttatggtggcagatattaaccaatacacaccctatattcaggcagttttcgggcaaaaaaatggggatgtgccacaaattccattttcactttcggataataaactttcagaaagcgatgtgttggtatcaagttacttaactttattacgcttaaaagaaagcaattttagtgcagaagatgtcttggtattgttggatattcctgcgatgcgagaacgatttaatatttcccttgctgatttaccattagtgcgagaatgggtaacggattcagggattcgtttcggtttgcaaaaaaatcaagatggcatcaatttcaattcttggcaggctggattagaacgaatgattttaggctatgcgatgcgtgaagaacagggcatttggcaagatagtctgggcttaaacagcagttatggcttaaagggcgagcttgctggaaatttatctcactttttcaccgcactttccgcgctgcatgaaacgctgcaacaagcacattccatcgaaaaatggcaagaaattttaaccgcacttttatcggatttcttcgtgcgaaatgaagacacaagcgacatgattttctatattcaagagaaaattaatgaattagctgagcatctaaaaacgctccattttaatgaagaattacaagcagaagtgatcgccgatgtcatcacaatgcaattggaagatgcgccaaatagcctcaaattccttgcaggaaaagtaaatttctgcaccttattaccaatgcgttcagtgccattcaaagtggtttgtttacttggaatgaatgatgcggattacccaagaacacaaacaccaaacagttttgatttaatgcaatatcattatcaaaaaggcgatcgtgttcgccgtgatgatgatcgctatttgttcttagaagccttattggccgcacgtgattattgctatatcagctatgttgggcgttccattacagataatcaaccgaaagaaccatccgtattggtaagtcaactgttggattatattaatcaagggcaaaaggaaaatgtccttactgtcattgaacatccaatgaccgcatttagcccagataatttcaaaaacaacgaaaaatttacccgctcttttgcgacaaaatggttgccaatagcacaatttgacgcgagttccaacaattcagaatttgccgtcactatgacagaaaacctagaaaaaatcgaagaagttgaactggatgctttagtcagctttgtggaaaatccagtgaaatttttctttgaaaaacaactcggtgtttatttccgcgataaagatgaacgcattgctgacagtgaaaacttcactttaagtgggttagataattattctctcaataatgacttaatttaccttgatgaacaaaattttgctgattattttagacaagcagaagtaaaaggcgtgttaccgcgcgcagagtttggaaaggtttatgctgaaaatattcgcgacaatgttttagaatttaaaaagaaaatagcagatcttggcgaagccaaacatgcttctgtcgattttaatctctccgtagattggcaaaacgaaaatcaaaaaatacgtttatttggttatatggacgctttatttggcgatgattcacaagtcattcactggcattttgctaaatataaagatcgttattgtattcgtccttggatttattatttaattcaatgtgttacacaagaaaatgcggtaccagcaaaattaattacgcaagataaggttctcgaattaccgcctattgagcgtgaagttgcacttgctcaattacaaatttacgtaaaagattatttacaaagtcaaattgaaatccaattggtgccaacagtaagaaatataagtgattttattgtaagtgatgaaaattccgtttctgaaaaacttcaggaattaactgaaagtaatggtttcgggccaaaagccgatccatattggtcacgagtattagcgcagacctcaagatttaaacaacctgaaaatattgcaaaattattaaaacaaacaaaagcttggtttggcttattattcgcacaaaagaagacaagaaagacacaaagctaatcgtcaaataacctattttttagtagaataacacccttttatggagaattatctatgcactgtccattttgtgatacagaagaaactaaagtcattgatagccgtttagtatctgatggttatcaagttcgccgccgccgtgagtgcggtcattgtcatgaacgttttactacttttgaaatggcggaattaatcataccgaaaattatcaaaactgatggtacacgtgagccattcaatgaagataaattgcgcaggcggtattcaacacgccttagaaaaacgtcctgtaagtgcagatgatgtagaaaaagcaattaatcacataattcttcaactgcgtgcaactggagaacgtgaagtgccaagtaagttagtgggtaaacttgcgatgaatgaattaaaaaaactcgataaagtggcttatattcgttttgcatcagtctatttaagttttgatgatattgatcaatttactatcgaaattgaaaaattaaaggattaattatgcttgaattttcctcacaagattgcgtatttatgcaacgtgccttagatttggcagccaaaggtcaatataccactacaccgaacccatcggtgggatgcgtattggttaaaaatggtgaaattgtgggggagggctttcattttaaggcaggacaacctcatgctgaacgcgttgccttagctcaagctggtgaaaatgctaaaggagcaaccgcttacgtcaccttagagccttgcgctcattatggtcgcacaccaccttgtgcattaggattaattgaggcgggcgtagtgaaagtcattgcggctatgcaagatccaaatcctcaagtcgcaggaaaaggtttgaaaatgttgtctgatgccggtatcgaaagtacggtgaatttattgaacgatcaagcggaaaaaataaataaaggttttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttccacaacagtcattgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgagccacgagatttaacaggctttcctgatttttgtgaacaaattatttttccgaaagaaaatttactaaaagaattaatgcgagaactgggaaaacgacaaatcaataccctttgggtagaagctggagcaaatttatcgggcagtttaattgatgcgaaattagtggatgaattgattatttacattgcgccaaaattacttggagacaatgctcgtggtctatgccaattaccgaatttaactaaacttgctgatgcaccattatggcaactcaatgaattagaacaaatcggtgacgatataaaattaacttacacaccgaaaggagtctaaatgcttaaaaaacttttccattccgcactttggggcttggctgctgcgggcgtgattttgtttgcggttccaagactgaataacagcaatatcttcacttcagacgatattatatcgttcaaaaatgctgtgcgtattgcctctccagcagtagtgaatgtttataaccgctctttttcttccgccagcattaatgataatgatcagctacaagtgaataacttaggttctggtgtgattatgagtaaagatggctatattctgacgaataaacacctcatccaaaatgcagatcaaattgtagtagcgttgcaaaatggaaatatttttgaggccagtcttgttggttcagatgatctcactgatctcgctgttcttaaaattcgtgcagataatctttcaactattccacaaaattcagcgcgtcaagctcacgtcggcgatgtggtattagcaatcggtaatccctacaacttaggacaaagcgtgtctcaaggaatcattagcgcaatcggtcgtaatgcggtaggcgattcggtgggcagacaaaattttattcaaactgatgcttcaattaatcgcggaaactcaggcggtgccttaattaactctgctggggaattggttggaattagcacgctaagtattggcaaaaccgccaatgaaatcgcagaaggactaaattttgccattccaatagatattgcaaatgatgtactacgtaaaattatgcgtgatggacgtgtgattcgaggttattttggtgtacaaagtgatattagttcaagtagtgaagaaggcatagttatcacagatgtaagtccgaacagcccagctgcgaaatcaggtattcaagttggcgatgtgattttgaaattaaataatcaagaaggtatttcagcccgagaaatgatgcaaattatcgcaaatacaaaacctaattcaaaagttctcgtcaccattctacgattaggcaaaatcttacaaattccagttgttattgaagaatttccagtaaattaaaaatagcggtctattttgaccgctgttttcattatatttaatactttcttttcaatttgaaaatttatttgttctaaccccttttctgacatttcgggcaaaagaaactattacgctgtccaataattaaactttcaatttttccaccgcactttggacaaggtttatctttattgccatataccaataattcttgtgcaaaataacctgggcgaccatcgggctgtaaaaaatctttaagtgttgttccaccttgaataatggcttttctcaaaacatctttaatcgtgttcactaaagagaaacattgattgcgagtcaaatttttagcgagtttaaggggatgaatgccacaaataaacaaactttcattcgtataaatatttccaacgcccactaccacagcgttatccatcaagaaagttttaagtgcggttgatttttgacgagattttttgaataaatattctgcattaaattcatcagaaagtggttcagggcctaactttaagaaaagatgaaagtcatctagattctccgtccacaaccatgcaccgaaacggcgaggatcgttatagcgtaataacttgccattattcactacaatatcaatatgatcatgtttatctattgcactatcctgtggcacaattcgcaccgaacctgacatgcccaaatgcccgatgatatagcctttttccgtgtgaataatcaaatattttgctcgacgagtgagatcgacaatttttacattttttagcgttatcaattcctctgatacagcccagcgcaatttaggctggcgcacgacaactttctcaatcgtaaaattcttaagataagggctaataccacgtagtgcagtttcgacttcaggaagttctggcataattttcaacttagtaagtagatagaataatgatataaagtgcggttagttttaccatttttttatattctttgaaaattaaaatgatgaatatttcaaaaatataggtagttatctaatggataaaatttatatatctcgtttgatctatgctaaaagatttttattttacagaataaccgcctgttttcagatacaagcggttatttttttgtgttaattgactaactaattaatcaatgggtggtgtgtaagtgccatttttgatgtcgtctttaatacgatttgcttctgttagtacttgagttaataacgctttaacattttccaatgttgcaatcgggcttagggtagtcattttcagcgattgtttgtcgcctactttagtcacgccaatattcgcttctcctcgagcaaagagttcatctgccacgttttggtttagtgcatcaataaattcagctggatagtcttttggtacgacacggaataacaccgatgcaaactgacttggcacaagcatttctaagtcaggggtatcgttgatgtattgctcgacttctttggtcagttttacgccgtgatcgatcattgaagcgtaaagatcttcgcccaatgcttcaagggtaaaccataattttaatgcgtcgaaacgacgtgtggtttgtaatgatttcgccactaagtttggcacgccgtgagcttcatcatattccgaattgagataatccgctttgtaatcgataaagcgatagttctctggatccttgagtaaaaatgcaccacaggaaatggtttggaagaagtgtttgtggaaatcaagcgtgatggaatcagttaattcaataccatctaagaaatagcgataatctttggaaagcaataatgcgccaccccaagcggcatcaacgtgtaaccacgcttgatattcatcggcaagtttgcggattgcttttaagtcatcaattgcgccagcatctgttgtgcctgcggtagcaacaatacaggcagtaattttgccatcagctttaagctgtgcaagtgtttgtttaagtgcaataagatccatttgtgcattggcatttgatggcacagtaacgactgattggaaacccattcccatcattgccatatttttttgtacagagaaatgtgcgttttctgaacaaatcactttcactttttgcatcgcttctgctggaataccatcacgttgtactgaccattcagagccgtcttcgtttttccagtggtttgcaatcgcccaatcgcgtgccaacaatacgcccattaagttagattgagtaccaccagaagtgaacacgcctgatgtgccttcgccatagcctgctttttggcgtagccagttgatcaaatgctcctccataattgaacctgctgggctttgatcccaagaatccattgattggttggtcgcattaatcagtacttccgcaatttggcttgttaccatcgttgggcaatgtaaatgggcaagtgagtgtggatgatgtactttaaggcttggattaaggaaaatttctaccaaatgatcgagtgatttctgtacacccataccctctttcgtcggattaaaaccgcttattaaggctcgcatttgtttgattgaaccgcctgtgtacattttttcatttttcagccaagcagagactgcttgcaccgcattatgcatcgctgtttcataatcgttaatggcttcgttatcgttgcaaaacaaagcttgtttgtgttgtttgaggtttgacataattattcctagatatgaattacacccaattttctgtacgtaatgctataactcgctcaaattctcttaaattgttactaaccagaattaacccttcactacgagcatgagccgctatatgaatatcattttcgccaatcaatttcccttgtttagagagttcagctttaatattgccgaaatgagctgcatgctttggttggtaatctaaaatggtgaggcgtgataagaaatcttcaataaccgcaatgtttctttcgggatattcgcttttttcagctccataatagagttcagccacagtaatgctactcacgcacatttttcctgcattttgattaaagcgagaaagaatttccaatggcctacgcttaatcacgtaaatcacaatgttagtatcaagcatatatttcaacactataaagcctcacgctctggttgaaatgcaatttctcgttcattcataaaatcatcgctaactgcttgatcattcaagaaaaaactatcccaagattggttgagaggcgataaaatccgatcactgcccgatacacgaaccgataattttttgatttcttcagaaaagcgaacttcagcgggcaaacgcacagcttgacttcgattagtcataaaaacagaggcttcaatcatagttattccttatgcttaattgtatatagcataagtatatcccagttttatacagttgagtagaaaaaaggtgggatttccctaccattttgaatttacaagcggtcaaaattcgcaaaacatttgcaaaatcagaccgcttttaattaactacgcaccactttcaatgcgtctacaacagattgtttgaagcgtttgatgaactcttcacattcactttggttgatgtttaccgcacaaagcacgcgaaccacgttgccaccgcgtccgccacgttcgagcaagagtttgtttttgaagcaagctttttggattgctgccgctaattcacaatcgcgtgggtaagcccctgtcgcatctttcgattggcgttcgtctacaatatcgatccccatcattaagccacgaccacgtacgttgccgatgcacggatattctttgcttaattcacgtaatgcgttggttaagtattcaccacgctcttgggcattttgtgcgaggttttcatcacgcataattttaagtgaagcatagcctgtcgccatcgctaattgattgccacgaaatgtacctgtatgtcctgcaggttgccaagcatcaaattctttacgaatagctaatacagctaatggtaagctgccaccaactgcttttgacatcacaataatatcaggctcaatgcctgcgtgttcaaaggcgaacattcttccagaacggcagaaaccagcttgcacttcatcgacgatcattaaaatgccgtgtttttgggttacttcacgtactttttgtaagaagcttattggtgctgaaacaacgccgccttctccttggattgcttctaaaattactgcagctggttttactacgccactttctacatcttcgatgaagttttcaaagtattgttcaactgctttcgcacccgcttcgccaccaatgccaaatgggcagcggtattcgtgtggatatggcataaattgtacgccaggcattaaattttcaacggcattttttgcaccaagattacccgttaaggctaatgccccttgggtcataccgtgaaaaccgccagagaaagcaatgatattgccacgccctgtgtaagttttcgctaatttgatggctgcttcatttgcatctgcaccagaagggcctgtgaattgtaagatatatttatctttcgggaagaatgacaataattcttcactaaacgcatctttaagtggagtggttaaatctaaagtgtgtaacggcaatccgctatctaatacgtctttaatggcttgcattaatataggatgattatgtcctaatgcaagggttcctgcgcctgctaaaaagtctaggtattcattaccttcaacatcagtaacccaacagccttgtgcttttgcataggcaaaaggtaatttacgaggataactacgtacgttggattccattacatcttggcgatctaaaaaatgttggtttgaagcaagaattgcttgtacaggggtaatcattgtcatttttgattaaaaccttctaaaagaggtgaaaaaaaataagtcgggtgccttgcgataaatttactgtttataaaacagacacatagggcatttgactcgctacttattaaaaaaagcgtttcagcttttttgtttttaccctagtttgcccattggacgggctaggttggaaacaggttttgatgtagggttacgtcaaaacggggacaattgtatattttttttgcaatatgaaaagtaaatttagcttcttacgagtcaaacggctaaataaaaagcaaacgtttctaataagaacaaataaaaaacccgagtttctactcgggtttaaaataattaaatcaatattatttgatttttgcttctttatagataacgtgtttacgcactactggatcaaattttttgatttccattttttcaggcatattacgtttgtttttatcagttgtgtagaagtgacctgtctctgcagtagaaactaaacggattttctcacgagcgcctttagctgccattttttagctccttagattttttcgccacgagcacggatttcagctaatactgcatcaatgccttttttatcaataatacgcatacctttcgcagttaaacgtaaggttacgaaacggttttcactttcaacccaaaaacggtgagtgtgaaggtttggaagaaaacgacgacgtgtcgcattcattgcgtgtgagcggttattacccacagctggacgcttgcctgttacttgacaaactctagacataataatctccaataattaaatataagctcgagcttacggttcggattgtttaaagctggttaaacctagcttgctacctcgtcaggtcgcgctaatccgacccgcttactatattaaaggtcgcaaattatactgactttgttttcatttctcaagtgtaaatgcgattttcctgaatgtaatcggtaaaaaaatggtcaatattataaaaatttataataaacaattctccgcgaaagaataacaatcgcttttccctacaattaaatgatcaagcacgcgaatttccattagttcagccgcatcttgaatttttttagtaataagctgatccgaataactcggctccgttatacctgaaggatgattatgtgccaaaattaaagctgccgcattacaatagagtgcttctttaataatttctcgcggatagaccgctgatacataaattgtacctaaaaataaccgctcttttttaatcaaacgatgttgattatctaaaaataaaaccataaatacttctctttcctcgtgttgcaattcagtgagtaaaaaaagttttactgtttcaggatcattaataatcggcgtacttaacatatcttgctttaaataacgcttggtcatttccgtaatcgcttgcagttgaataaattgcgtaatacctaagccttttacagaacagaaagcttttttatctgcagaaagtaaagcgtgcaaggggccaaaatgcgttaatacatttttagaaagtgacataacaggacaacctttgataccagtacgtaaaaaaatcgcaagtagttcataatcacttaatgcttttgctccaaatgccagcaatttttcccgtggcattaattcatcattgttttccatatatttataaaagaaaaataagaaagattttgaccgcactttttaggtttgacgagcaagtgattcaaaatctgcgatgcatatcgtaaaaatagcgttgggcattcaataaaattaaagtaaaataacgaaattgtggataagtactaacaaaggttaaaacatgaaattaaacggaaagcatattgtagttggcataactggcggtattgcagcctataaaacaatagagttgattcgtttgttacgcaaagcagaagctgaagtacgtgtagtattaacccctgctgcggcagaatttgttacgcctttgacacttcaagccatttctggcaatgctgtatcgcaatctttacttgatccacaagcagagctggcaatggggcatattgaacttgccaaatgggctgatgccattattattgcgccagctagtgcagattttatcgcccgtcttactattggcatggcgaatgatttactttcaacaatttgtcttgcgactaatgcgccaatttttcttgcgccagcaatgaatcagcagatgtatcaccaatccattactcaacaaaatttaacgactcttcaaacacgtgggattgagcttatcggccccaatagtggttttcaagcttgcggcgatatggggaaagggcgtatgtcagaaccagaggaaatttttaccgcactttctgactttttctctcaaaaacaagatctacaaggattaaatgtttccattacagcaggcccaacgcgtgaggcaatcgatcctgttcgttatatttctaaccatagttcagggaaaatggggtttgcgattgctgaagcatttgccaaacgaggggcgaacgtcacgctgattgcagggccagtgaatttaacaacaccaaaaaatgtaaatcgaattaatgtcatctcagcacaagaaatgtggcaagcctctcttgaaagtgcggtaaaaaatcaaatttttattggttgtgcggctgttgctgattacagagtaactgaagttgctgagcaaaaaatcaaaaaatctggcgatgaaatatctatcaaattaattaaaaatcctgatattatctcagatgtaggacatttaaaaacacatcgtccctttactgttggatttgcggctgaaacccaaaatgttgatgattatgcaaaagataaacttgaacgcaaaaatcttgatatgatttgtgccaacgatgtatctggcggacaagtttttaacgctgatgaaaatgccttgcagcttttttggaaaaatggtcataaaaaattatcgctaaaatcaaaagtagaacttgccgctgatttagtcaatgaaatcatcgaacgctatcaaaaaaccttataattccaaccgtacttttacctaaaaatgaatttcaaacggagtattaaatgaaaaaaattgacgtaaaaattttagattctcgcattggtaatgaatttcctttgccaacttatgcaactgaaggttcagcaggccttgatttacgtgcgttgatcgatgaaagctttgaaattcaaccaggcgaaaccaaattaattccgacagggctatcaatttatattgcggatcccaatttagctgccgtgattttgcctcgctcgggtcttggccataaacacggcattgtgttaggaaaccttgtgggattaattgactccgattatcaagggccattaatggtatcaatgtggaaccgtggaaatgaaccattcaaaattgaagtcggcgatcgtattgctcaacttgttttcgtgccagtagtacaagctgaatttaatattgtagaagattttcaacaaaccgaacgtggagaaggcggtttcggtcattcaggtaaacaataatttatggtagaagaacaattatctttatcaggcgtagaagaaattgcgcctaaaattgaaacaccgaaaattgaaaaaagaacggtaaaagaacgtcgtcagcaagtgcttacagtattgatacatatgcttcattctgaacgtggaatggaaagaatgacaaccgctcgtctagcaaaagaagttggtgtgtcggaagctgcgttatatcgttactttccaagcaaaacaaaaatgtttgaagcactaattgaacatattgaaagtactttgctgagccgaattacagcatcaatgcgtaacgaaactcaaacaatgaatcgcattcacgacattttacaaacaattttggattttgcccgaaaaaatcccggcttaacacgtgttctaacaggtcacgcgttaatgtttgaagaagcgcaattacaagcacgtgtggcacaatttttcgatcgtcttgagatgcagtttgtcaatattttgcaaatgcgtaaattacgtgaagggcgtgctttcaacgtggatgaacgtataattgcctcacatttagtgacactctgcgaaggacaatttatgcgctatgttcgtacaaatttccgtctgaattcaagtcagtcttttgaacaacaatggcgttttatcgagccactttttgcctaattgactttaccgagtaaatatatgattattccttggcaagaactagaagcagaaacattagataatatcgtagaaagcgtgattttacgcgaaggaaccgattacggtatagaagaactttcactcaaccaggaaaaaacaacttttactgactcaaattcgcaatggaattgcgttgattgtatggtctgaattacatgaatccattgacatcaaaaataaaacggaatttttgaaacaggaatgtaaggagcaagaatgtcaaatgaattaaccgaaattgatgaagttgtaacctcctctcaagaagaagcaactcaacgagatcccgttttagattggtttcttactcactgccatttgcataaatatcctgcaaaatcaactttaattcatgctggggaagatgcgaccacgctgtattatgtaattaaaggttctgtaatggtatcttcaaaagatgatgaaggcaaagagatgatcctcacttacttaggtgcaggacaattttttggcgaagcgggattatttgatgaaggttcaaaacgatcagcttgggtaaaaacaaaaacaacatgtgaaattgctgaaatttcctataagaaatatcgccagttgattcaggcaaaccctgaaatcttaatgtttctcactgcacaattggcaagacgtttgcaaaatacatcacgtcaagtcacgaatttggcatttttagacgtcgcaggtcgcatcgctcaaactttaatgaacttagctaaacagcctgaagcaatgacgcatcctgatggtatgcaaatcaaaattacacgccaagaaatagggcaaatggtgggttgttcacgagaaactgtggggcgcattattaagatgttggaggatcagaatcttatccacgctcatggaaaaacaatcgttgtatatggcgcaagataatttttcatcataatttattcaaaataaaaccatccgaaattaatttgggtggtttttgtttaattggaaataatattcaaaacattaattgacaattaatataaaggattttatcattgctccacttcttatggatattgtaggaagacaggattggtctcctgatatagtggctttaaaggtttaaaccttattgcatagttttatgctgcaaaagctagaacaccgagatgcattttttaatctatggtgggctgggtagaaatcccgcagggatgcgtgcagtaagccacttgctgttaagaccaattctgcttagttccaccacccttctttcaaattccctagccttttctagcttaccttaattaatcttttttctttctagtaaaactaatacttcatagtgagatgtttgcggaaacatatcaaaaagttgaattttcaatggtttataacaagttagatgctgtaaatctttacccattgtcatggcattacagctggaatacaagataaagtgcggttgaatttggttgagaaattcacttaattcctttccaattccacgacgcggcggatttacaatcacaagatctggcttattttcatttttattttcaatcacgcttgctgcatctagagattggaaatttacatgttctaaacctaatattttcgcagaatgactggctgccaaaatagcagaggaagaaatttcaattcctgttaatttaatgggttttccccatttttcctgcaacgctttagcacaatgtaagccaaatccccctacgccacaaaataaatcccacaagttataaatagggaattcagccacccattgttgagcggttgcatataaacctgcagccactttagggttagtttgaaagaagcctcgtggacgaataaagagcggaataccgttaaaattttcaggcaaaaattgttgttctgtcagaaaaatttcttgttcgccctctaaaatagccgcgtgctgtggttgtaaattaatactaatcacttctaagtgcggtaatttttccaataatttgggcaattctcgacgaattaatggtaatttattttctgtacgtaacacaaaacgcaacatcaatttttccgtcgcgatactttctgtcagcaaaatatatttaagctcgcctttttgtttagcaatgttataaggtactaaacctgcgcgaccaataaaatctttgagaattgaaaaaattgctgaaaaatgtgtaggataaagaggacaatcacacaaatcaatcgcactttgtggatcattaggattttttaaaatgccaagtattgggcgttcaacactaccactaacaaccattttagctttattacgaaagccttgttgattagattgaaaaggagccacccattgagcttcatcgtaattaatagaaatcagttgctgctttaaatgatattgtttttcagttagctgctgactacaaggtatttcaagccattggcaagaacgacattcattttgttgatagtatcgacaatcaatcattttttgctgcctgaatgtctaaccaacggctttgaatatcagctaatttttgataattaagtctccaacgttgatctgaaattaagtcgttccaattaatcactctacgtttaaataaactttgtaagcgagcttgacgagccataaagtgcggttgattttcagtaagttttagattatctaatacttgaatgacaccttcacgttcattacacagtaataaaagatcgcaacctgcattgagtgcttttttactacgctctacaaaattccccattactcccgcgcctttcattcctagatcatcggaaaaaattgtaccttggaaatttaatttcttgcgtaaaatttctttcaaccaatattttgaaccacttgcaggctgactatcacattgcgaataaatcacgtgagcaggcataatcgcatcgagtttattctgtgaaatcaactgttggaaaggttggagatcgccactaaaaatttcttcttttgtacgatcatcataaggcgtttctaaatgagaatcggctaatacatgaccatgaccgggaaaatgtttacctgtagatgccatacctgcttgatgcataccatcaataaaagcggtggctaaatttaccgcactttttacatcagatgaaaaactgcgatcaccaatcgctcgacattcatgccccaaatccaacacaggagcaaaactcaagtcaatatccaaggcaatcatttctgctgccatttgccaacctgcttctttagcaaaactcacttgttcagttgctgacagtgtttcttgaaaagcctgcattgaaggcaacattgtaaatccatcacggaaacgttgaactcgtccaccttcttgatccaccgtaattaataaaggctttttcactcgttggcgaacagaacgaattaattcttgaatttgttctctgttttcaaaatttcgagtaaataaaattaatcctgcaacaagagggtgagaaagtaactcaacttcctcttgttccaactcttttccttttaaatcaattaacaacgagctcataaattattttaaataaaggcgataatttttactttctacagtaggtttagttaaatcaattgatttttgctcttgtggttttagcaaaaattgagcggaatagctttcttgctgattttcccaaatttgggttacccctaaatgatcgtaccaatacaaatggtaacttatattcaaaagttgctgacttttattttttataaccgctgatttttgagtcgtttcaacttgaatcaaaggcgaaagagacgacgtaatattcaaaatcggctttgttgaataagttaagttttgttctgaacttgaacaagccacgagcataaagctcgctaaaattagaaaatattttttcattatttcgctaacattctacctaaaggttctccaccaactaaatgcatatgtaaatggaatacttcttgcccaccatgtttattacaattcacaattaggcggtaaccatcttccgcaacaccttcttctttagcgagtttagccgctacgctaaataatcgacctagcgctacttcatcttgctccgtcacatcattcactgtgggaatgactttatttggaataatcaaaatatgtgttttagcttgaggggaaatatcacgaaatgcagtgactaattcatcttgatagacgatatttgccggaatttctttacggataattttactaaaaattgtttcttctgccattgtttgctccctataaaaagtgcggcgaattaacctgtccataattgttgcttatttagtctaacttttaaggacagagcaaatcaatcgcactttttgttttacaatgaatttaattatgcaaagtatcgaacttctccattgcccactacattttctacacaacgagcacaaagtgttggatgttctgggcttaccccaatttcgtcagaataatgccagcaacgagggcatttttctgcgttagaacgtgttacgcttaccgcaataccctctaattcgctgtccgctaaatcagcaggtttttccgataaagattttacatctacttttgaggtaattaatacaaaacgtaattcattgcctaattgtgctaataatgcacgatattcgtcattagcataaacggtcacttctgcttctaaaccgccgcctatttctttattgttacgagaaatttctaatacgcggttcacttctgaacgaactttaatcagttgttgccagtaagcatcatctaatttttcatcctcgcctaaaccaaataagccttgatagaattcttcagtaaatacgaattccgcacgagcactttcagtttgtggcaagtgttgccaaatttcatcggcagtgaaagataagatcggtgccatccaacgaactaatgcttcagcaatatgccataacgcagtttggcaactacgacgcgcaaggctgtctgctttggttgtatattgacggtctttgataatatctaaatagaatgaccccatttctaccgaacagaaacgcattaaacgttgtaccacagtgtggaattgatagttatcgtatgcatctttaatttcattttgtgcatctaatgcacaagctaccgcccaacgatctaggctaatcattttttctggtttgactaaatcacgttttggatcaaaaccattcaagtttgctaataagaaacgagcggtgttacgaatacgacgatagctgtccgctgcacgttttaagatctcatcagaaacggtcatttcacccgtataatcagtagaagcaacccataaacgtaaaatgtcgccaccgaatttatccattacttcttgtggtgtcacgatgttaccgatagattttgacatcttacggccttgaccatccacagtgaaaccatgagttaatacttgcttgtatggtgctttgctgtctgttgcggtagaaagcattaaagaagacataaaccaaccacggtgttggtcggaaccttccaaatacatatcaatatcttgaccgttaaattctaggcgatttgcaacaacagaagaataggttgatcctgagtcaaaccatacatcaagggtatccggcactttgcgataggtttctgcgtccgcacctaataattctttttcgtctaaatcccaccacgcttgaatacccgctctttctacacgtttcgccacttcttcaagtagatccaaggtacgcggatgaagttcttcggtttctttatgcacgaacaacgtcatcggcacaccccaagtacgttggcgtgaaatacaccagtctgggcggttttcaaccattttctcaatacgtgcttgaccccaatctggaatccagcgaacttgtttaatttcgcctaatgcttgttggcgtaaaccttgcgtttccatgccgataaaccattgcggtgttgcacggaaaataattggcgttttgtgacgccagcagtgtggatagctgtgtttgattttttcaacttttaataagttacctacttcttgtaatttttctatcacaagcggatttgcttcaaatacgcctttgcctgcaaagaattcggtcgttgaaataaatttaccatcattcgatacaagacccgccattggtaaatcatattgtttacccacgataaagtcgtctaaaccgtgatcaggtgcggtatgtactaaacctgtaccgccatcagtggttacgtgatcgcctaaaatcactggcacagtaaaatcatagaacggatgatggaaacggcttaattcaagatcatcaccttttacagaacccagaatttcaatgtgctcaatacccaccgcttttgccactgactcaactaattcagcagctaaaattacacgctcatcgccaagttggactaagttgtattctaagtctgcattcaccgcaatcgcacggttagatggcatcgtccaaggtgtggtagtccaaatgatggctgataatttaccttgtcctctaccttgtgcagaaaatttagcttcaatttcatccgcactttccgcagggaaacgaacgtaaattgacggagaaactttgtcttcatattccacttctgcttctgctaaagaagaaccgcaatccaaacaccagtgaactggttttgagcctttatacaaatgaccattttcaatcactttacctaaagtgcggataatattcgcttcggtatcgaaattcatcgtgagatatggattatcccaatcgcccaacacacctaaacggataaagtctttcttttgaccctcgacctgttccgccgcgtattcacgacatttttgacgaaattctgccgcagaaattttctcgtttggtttacccactaaaccttctacttttaattcaattggcaagccgtggcagtcccaacctgggatataaggcgaatcaaaacctaacgccgttttggatttaataataatatctttcagaatcttgtttacagcgtgaccaatatgaatgttaccattcgcatacggagggccatcgtgcagaataaaagattttttgcccttactcgctttacgaattttttggtaaagatttttctcgtaccaatttttcaacatatcaggttcgcgcttagctaaatcaccgcgcattggaaagctggtttccggtaggttaagagtgtttttgtaatcgactgtcattttattttccaatttttacattttaaaattaactgttaaaaaacgctttcgcagtttctacatctttctcaatttgcactttcaaatcatcaaaagaggggaatttaatctcgtttctaatcttgtggcagaattccacttccaccatttggccataaatattctgagaaaaatcaaataaatggacttctaataattgcattaatccatttatagttgggcgttttcccatgtttgccacgccgttaaaaatctcccccgattttaaccgcacttttacggcataaacgcctttgattggatttacttgtctatgcaaacgaatatttgccgttggaaatcctattgttctgcctaatttattcccatgaatcacacgcccgaaaatacgataaggtttaccgagtaaattttctgcaagttgtaagtcatcattcgctaacgcttcgcgaattgccgtgctactaattcgctgtgcatctagacaaaaactacggttatcttcaacaataaaaccaaaacgcttactagctgcttgcaacatggcaaaattaccttggcgttttgagccgaatttgaaatcatcgccaatgcttaaaaatttcacatgtagatgattaacaagcgtttgttcaataaaaacatcggctagttgctcggcaaaagtgcggtcaaatttcgccacaattacgacatcgaccttagccttttcgagataataaattttgtcacgcaaacgcattaaacgggctggtgcatttttccccataaaatattcacgaggctgtgattcaaataacaataccgccatgggtaaatttaattcgtcagctttttgacgcaaatggcgaaggacggtttgatgccctaaatgcacgccatcaaagttgccgatcgttagcgcacaaccttgtaaaacacgatttgcattgtgaagcccgcgaattaattgcatgtccttatccatgaaaataagagaatttcggcattatagcgagaagttagttttttgtcagcaaatggtgcttgcgaacgcctaataaaatcaacgttgcaccataaactattgcggctaatacaatcaaccaaacaagccaataaacacgcataaagaaatccattttcgcccattggttgatttcaggcacgtaataccaaactgccgcacccattgcgattgccgccaataaaactttgacaaaaaagaccgcacttttacgtgaaaaatggtacacatccgctttggctaagccgcgatagagtaaataagcattaagggttgcggacatcgctgaagcaatagctaatcctacatagctgaaaggaatcgccaatagattaaagcccatattactcaccatggcaataatgccaatttttactggcgttttggtatcttggcgagcgtaatagccattggcgaggattttaatcaacataaagctaagcaaacccgcattaaacgcccgtaaagaataagaggcggcataaacatcatttagcataaaatttccacgcataaagagcgtaagtaacatcggttgagccaatacagcaataccaatggctgcaggaacgccaagtaagaaaatcattcgcacgccccaatccattgtattacgaaaatcaaccgcacttttagctgaatcgccttcacgattaacgtggtggcgagcaagcgttggtaaaattacggtagaaatcgcaatgccaaataaaccaagaggaaattccagtaagcggtcggaataatacaaccagctaatagagcccgtcattaagaagctcgcaatcactgtatccagcaaaagattaatttgacttaccgatacaccaaataacgcagggatcattaatttacgaattttggttacgccttcatccctccacgcccattttggtttcaccagcaaacctgcttgtttcataaatggaatttggaataagaactgtaataagccgccaagaaaaattccgatagcgagcgcaagatctgggttatccatttgtggtgcgaggaaaagtgcggtggcaatcatcgctatatttaataacacgggtgaaaaggacatcacaccgaattttccaatcgtgttaagcacagcgccagaaaatgccacaaaagtnacaaaccataaataaggaaaagttattttaagaagaagagaggcttgttcaaacttatgtgcatcagggccatcattcatccaatcggtgaaccagcccatcccaaataaagcggcaacssacagcgaaccaaccatcgccaaaatcgtnacaatactcaccaatcccccaagggtaccagaaacttttccaataaattcacgggttttattcatatcgccagattgttgatattctgcgagnacagggacaaaagcctgtgaaaaagccccttcagcaaataaacggcgaagnaaatttgggatacgattagcaaataaaaagacgtccgctgcggcgcctgccccaatgagatgagcgataactacatctcgcacaagacctaacactcttgataataaagtcatagaactaacaacaatgctagattttaaaagtcgtttactcaaaatattcttctctaccctaaaatttttgcctaattgtatagaaattttgtttttacgctatattccgtgaaaaaaaactgataaaatccgccacacatcgtttgtgtgagcccatattgaaagagcttgtaaaaataacgatacttactttcggttgtgtctcaccgaaatcaacacaaattttccattgacaaaagtataaaaaatcggcatattgatgccctttattttgtctatcaatcaacagaaattttaggagtttgaccttggctaatatcaagtcagcaaaaaaacgcgcggttcaatctgaaaaacgtcgccaacacaacgcaagccaacgctctatgatgcgtacttatatcaaaaaagtatatgctcaagtagcagcaggcgaaaaatcagcagctgaagcagcattcgttgaaatgcaaaaagttgtagaccgtatggcttctaaaggcttaatccacgctaacaaagcagcaaaccacaaatctaaattagctgcacaaatcaaaaaattagcgtaatttttagctagaaagaatgaaaaaataaaaccgcactttaaagtgcggttttttattgcatcgaatgttagactaaagtaacaacatcgatccccatttgataatatcaaagaagaatttattttgattggttgcaatgccatcagaattttttggtgtgccatcttcatttttttgcacttccaccatgccatttttatattgacctttcacggcagccaaatcatcgcgcgcttcgttacgcaatttcaaacaagactgtttagttaagggttcaacattgctcactctggtacggaattttttaaactgatagcttgcataattcattgatttttcatcggcttggataatcttcacatattgttcgccaataattttttccaacggatagaaaaagacatattgtgagtgaatatagctatcttcttttgaaaaatgctgttgcaaaattcgagttaaatttgggtaaacgcattgttctacttgcttacttgcaatcgcccattgttttgcatgttgatcagacagttgataatcagctccagcaaattccgctggaattgcggattgttggctatcaaacattgaacagccagacagcaatgctgccatacctaaggttgcaattaatttcacatttgatccttataaaagtgagaatgtgcaaaattctagcaatatcttcacaacagataaagcagcaaatgaatttagttttcctgatctgaaaaacttccgctataatgaccgcacttttttacgttaattaaaaggaattcttatgcaaaatccaaaagatgatgttttatatgcgcctgttgaatggatcgatcacagtgaaggctatagcgatattcgctatcataaatccactgatggtattgcaaaaattaccattaaccgccctgaagttcgtaatgcgttccgtccacaaacagtgaaagaaatgatgactgcattttctgatgcacgtttcgatgaaaacattggtgtcattgtattaactggcgaaggcgaaaaagcattctgttctggtggtgaccaaaaagtgcgtggcgattacggtggttacaaagatgacagtggcgtacatcacttaaatgtattagatttccaacgcgatattcgttcttgtccaaaaccagttgtagcaatggtggctggttatgcaattggtggtggccatgtattacatatgctttgcgacttaacgattgctgctgaaaatgccattttcgggcaaactgggccaaaagtcggttcattcgatggcggttggggcgcaagctatatggctcgtttagtggggcagaaaaaagcgcgtgaaatttggttcttatgccgtcaatataatgcacaagaagcattagacatgggcttagtcaatactgttgtgccttacgctgatcttgaaaaagaaaccgtgcgttggtgtcgtgaaatgttacgaaatagcccaatcgcgatccgttgtttgaaagcggcattaaatgcggattgtgatggccaagcaggtcttcaagaattagcgggtaacgcaacaatgttgttctacatgactgaagaaggtcaagaaggccgcaatgcgtttaacgaaaaacgcgccccagacttcagcaaattcagacgtaacccttaatttatcgttctaaagtgcggttaaaaatcttcgtgaattttgaccgcacttttgtattgggagcaagcatggctgaaaaatcatttaatctttaccgttattctatccccgttgatagccaacttattctgcgtgatcgttttttaaaacgccgtgaaggcttaatcgtaagagtgagttgcagccgagacggttggggagaaatcgctccgctacctggttttagcgaagaaaccttagaccaagctcaagaacaagcaatagaatggctaacgacatggtgcaatgcaagctgtgacgcacctcgcgtaccattagatggcacctatccctccgttgcttttggtatcagttgcgcaatggatgaaatgaaaggttatttacaagctgaaggcaattatcatacagcaccactttgttatggcgatccagatgaattgtacgccaaacttgcgagcatggaaggcgaaaaagtagcaaagatgaaagtgggcatatacgaagccaatcgcgatggattaattgccgatatgtttttagaagccattcccgatttacaattacggcttgatgcaaaccgccattggtcgttagaaaaagccttacaatttgccgctaaagtcaaactgcaacatagaaaacgtattcaatttttagaagaaccttgtaaaacacaagcactcagccgtgaatttgcagttcaaaccgacatcgcgattgcatgggatgaatccgtgcgagagcctaatttttgcttggaaaaagaaccgcacttatcggctgtcgtaatcaaacccactttaattggttcaattcaacgttgtactgagctcattaaccaagcacattcgttaggtctaaaagcggttattagttcaagtatcgaaagcagtttagggctctctcagcttgcacgaatcgcacaacaatacaccccgaatgtgactccaggcttagatactttagatttgatggaatatcaagtactacgcgcttggcctagttctgatttacctattgttgatttagaatctgaatttatcactaaaattatctgattcgaccaccaaaaatcgaaaaaaccagtataatgtgccacacaaaaaggattaaaaatgtcgcaaacacacagaattttgctgttaaatggcccgaacttaaatatgttaggggctcgcgagccaaaacattatggcagtatttctcttgaatccattgaagagaaaatacaaactttagccactcaacacaatgtaaaagtggaatgttttcaagccaatagtgaaggaaaattaattaataagatccacgaaagttttcaacaagtcgattttattttaattaatcctgcggcttacacccataccagtgtagcattgcgcgatgcacttttagctgtctcaattccttttgtagagattcatttatctaacgtgcataaacgtgaaccatttcgtcatcattcttattttagcgatgtggctgaaggcgttatttgcggtttgggcgcgaaaggttacgagtttgcctttttatttgctatggattaccttgctaaaaaataagaaaatcgagtatttttggcgaaattcacagaattttatcgcaaatttgaaaaaattaaggtaatctttgcaacacaaaagtaagtttattcataaccgcactttttcctttaaaagtgcggttaaaatttcaatctttttaggaagaacgtatggacattcgtaaaattaaaaaattaatcgaattagtagaagaatcgggcattactgaattagaagtgcaagaagaagagggtacagtacgtattagccgtgctgcaccagtaattgctccagcagccgttcaatatgctgcagcaccagtagtagcaccgactcctgccgctgcaccagctcaagttccagcagctgcgacaaccgcaccagccgcatcggatgagttatcaggccatcttgtacgttctccaatggtgggaacgttctatcgcagcccaagcccagaagcaaaagcattcgttgaagtggggcagtctgtgaaagttggcgatgcgctttgtatcgttgaagcaatgaaaatgatgaaccgcattgaagcggacaaagctggcgtagtaaaagcaattcttatcaacgacggtaacgccgttgaatttgacgaaccattaatcgttattgaataatttccaatatttttgtcgggcggactttagtccgtatttcatatacaaacaattagagcgaatttatcgtaggcgatataaattgaaatctgttcacgccaaattttatagggagaacaatatttcaagagcctacataaaaattcacgtctatctgactaaacggactcttttatgttagaaaaagttgtgattgctaaccgcggtgaaattgcactacgcattttacgtgcttgtaaagaattaggtattaaaactgtggcggttcactccactgctgatcgtgatttaaaacacgttttactcgctgatgaaaccatttgtatcggtccagcaccttccgcaaaaagttatttaaatattccagctatcattgctgccgccgaagtaacaggtgcggatgcaattcatcctggatacggtttcttatctgaaaacgctgactttgctgaacaagttgaacgttcaggtttcactttcatcggcccaacagcagatgttattcgtttaatgggcgataaagtttcagctattaaagcgatgaaaaaagcaggcgtgccttgtgtaccaggttcggatggccctgtaagtaatgatattgctaaaaataaagaaatcgccaaacgtattggttatccaatcatcatcaaagcatcaggcggcggcggtggccgaggaatgcgtgttgttcgtagcgaagacgcattagaagaatctattgcgatgaccaaagcagaagcgaaagccgcattcaacaatgatatggtttatatggaaaaatacttagaaaatccacgtcacgtggaaattcaagtattagcagatacccatggaaatgcggtttatttggctgaacgtgactgctcaatgcagcgtcgtcaccaaaaagttgtggaagaagcaccagctccaggtattgacagaagaagttcgccgcgatattggctctcgctgtgcaaatgcttgtgtagaaatcggctatcgcggagcggaacctttgaattcttatatgaaaatggcgaattctactttattgaaatgaatacccgtatccaagtagaacacccagtaacagaaatgattacaggtgtagatttagtgaaagagcaattgcgtattgcagcaggcttgccaatttcctttaaacaagaggacattaaagttaaaggccatgcaatggaatgccgtattaacgcagaagatcccaaaacattcttaccgtctccgggcaaagtaaatcacttacattcgcctggcggtttgggcgttcgttgggattctcatgtttatggtggctatactgtgcctccacattacgactccatgatcgcaaaacttatcacttacggcgatacacgtgaagtggcaatccgtcgtatgcaaaatgccttatctgaaacaattattgatggtatcaaaaccaatatcccacttcatgaattaattcttgaagatgaaaatttccaaaaaggcggaacaaacatccattatttggagaaaaaattaggtatgaatgaataattaaaattttaaacagctaacagatgttagctattctcttattgattttatagacttttattataaaaaaagatttcatagagaattaattgagacaactaacagctttttctatacaatccacccttctaattatttttggacaaattatgacaatcaacttaacaaaatttagtttaacgatacttgtagccttaacattaacggcttgtggaagcagtggtggaagtggtgattcacaatcagcacatacacctagtacatcaattcatacacaaaataattctactccaaacaagaatacatcaactcccccagtaaacgtttctaatgctaataatctggaaataaaaaataatgataaaactggtggtgcttttattatttcaggagaagatggacacgtaacattaaaaaaagtagatattactactaattctgatctaaatgttttgtatattgatgggactaaaatccctctttcctcaccttctattaaatcaaatggatggttaaatattagatcgggcacaggcaaagtttctattgatggaatagaaacctcacgggatctcaaagtttgttgtggaaaatacaccgatactcgtattggtaaagtgttaagtaaaaataaaaatgaagatacctacttcttttataatggtaacctaacgagaaatatgcccgttggtggtacagtaaattataatacaggcgatagcatcctatcatcttaccatgacgaattaggtgatactgatgaagccgttggcacttctcaattcagtgctgattttgtaaataaaaaattgacaggttctttatctgttaatgagaaaaaattaaatattaatgctgatatttcaggtaatacgttctcaggtactactcaatcagatgcttttaaatctcaaggtattgccgaaggtaaattttatggtgaaaacgcgaaagaattaggcggtttagtgaaagcaaatgataattcttggagtggtgcatttgcagccaaaaaataatctttattttatttaattaaagcaagcttaggcttgctttattctttcccaataaggataaaaatgagtatacaaactaaatttattttatttctcagctcatcattatttcttaccccatattcggttgctacagaaaaatctccacaaccacatgatgggcgtttagatgaacagctacatttggctaaaccaaatttgccacaaaaaacacccgcacttttgacgaataataatccgtcaaaattatctattacaaaagaagaattagccaaacacccagacttgattattcgcggtcttatccctgcagtattacaaaataatggtgaggcggtacaacttttattgcctctatatcaaccccttcctaaaaaagatccgttcttgttagaatgggcggaagcaattgacttacgagaaaaagggtatttttctgattccgttaaagcttatcgacacttattttcacaaaaaactgatcttttacctttacgctatcaattagcccaagccttgtttctaaataatgataacgaggcggcaaaagatcaatttcaaaaattaagagcagagcaagtttcctctgattctgtaaaaataattgaacaatatctttctgccttaaatcaacgagatcaatggaaaatccaaggtggatttagttttttaaatgaaagtaatattaataatgcgccaaaagccggcacaaaaattggcaactggacagcttgggaaaaagaaagtgccagaggattttcgtattttgggaatgctgaaaaaaaatggtcattacctcacaaccactttacaaaattgtccttggaaggcagtgggaaatattattgggataacaagaaatataatgaatttaacgcaagagctggtgtgggtcttggatatcaaactgcacgatttgaactctcattaatgccatttactgagaagcgttggtatgcgggcggctcatctggcggaaatgcaatgaaacaatactctaaaaattcaggtgctagattggatttatccaattggctaaatgaaaaatggcaaatttcgaccgcacttgagtatggtgaacaacgctatgaaactcgtaaacatctaaatggaaataactatctagcttccgctacgctactttacttggcgaaaagtggacagtattagtttggtggagctgattataatcgcgaaaatactcgagatttagataacgcttatcaacgaaaaaatgtccgattaggatggggacaagaatggaaagctggtatatcaactcgtttaattcttaattacgcacgacgtgcctataaagaaaaagatcttatcggtattcgtcaaaaaaataaggaatatgcatcagtccttactatctggcatagaaactttcatatttggggaattacaccgaaattatcttggtcgtatcaaaaggtaacaagtaatcatcctttttatgaatatgataaaaatcgaatttacgtagaaatcagcaaaaccttttgaattattcaaaaaagttgtaagattagcaaacacaagggacgtatgaaatatacgccccttataccattcaaaaaatatactttcacttataaaaaattttaaggaagaaatatgacattaaaacaacgttatcaacaagctggtaaagaagccagttgggcattgagcctatctattttatatgtgataggttggtgcttatgtgcttatttgcctaaagaaactcaaggccctatcggctttcccctctggtttgaactctcttgtatttatttgcctattctgtttattgtaattggtcattggattatcaaaattatttttcaggatatttctcttgaaattaacgatcaggggaatcaaaaatgaatttaggtattattcttcctttaattatttatctcacttttgtttttggtgcagcaatttttgcctatgtaaaacgtacaaaaggcgattttttaacagaatattatgtgggaaatcgatcgatgactggttttgtgctcgcaatgacaactgcatcaacttatgccagtgcaagtycttttgtcggagggcctggagctgcttataaatacggattaggttgggtattacttgcgatgattcaagtgccagtcgtatggcttgcattaggtgcattaggtaaaaaattcgcgctattatcaagagaaaccaatgctttaactattaatgatcttttcttttatcgctataaaaacaaatatttagtttggctatcaagccttgctcttcttctcgcattttttgcggctatgaccgtgcaatttattggtggtgcgcgtttattagaaacaaccatcggcatttcttatactcaagcattactcttatttgctttaacggtaggtatctatacttttatcgggggcttccgtgccgtcgtactgacggataccattcaaggtaccgtcatgatttttgggactataattctccttattggcacgatttatgccctcggtggtgtagaaagtgcggttaataaattaactgaaattgatcctgacttagtcacgccttacgggccaaatggaatgttagatttccaatttatggcttctttctggatacttgtctgtttcggggtggttggtcttccacataccgcagttcgatgtatggcatttaaagacagtaaagccttacatcgcggtatgctgattggaaccattgtactttcaattattatgttgggtatgcacttagctggtgcgcttggcagagcggttattccaaatttaacggtatcagatcaagtaattccaacattaatgataaaagtattgccgcctattgttgcggggattttcttagctgcaccgatgtctgcgattatgtccacaattgatgcacaacttattcaatcttcttctatttttgtcaaagatttatacctttctgcgaaaccagaagccgcaaaaaatgagaaaaaagtgagctatttttcatcaattattacgctgattttgaccgcacttttaatctttgccgcactcaatccaccagatatgattatttggttaaacctatttgcctttggcggactggaagccgcatttttatgggtaattgtactgggtatttattgggataaagcaaatgcttatggtgcgttaagctcaatgattatcggcttaggaagctatatcttgctcactcaacttggcataaaattatttaacttccatcaaatcgtaccgtcattagtatttggattaattgcatttttagtgggtaataaattgggcgaacgtcgtattgaaaaaactcaattaaaagttaccgcactttaagtattaatcaatatgctgtcaccttcttctaaatgagaggaaggtgatatttaattttctcactttcagcaatttctacgctaaaacatagaattgcaacaattcacagggatacatcaatgctctatcaaattcttgcgctacttatttggagcagttcattaatcgtcggtaagctcacttattcgatgatggatcctgtgcttgttgtgcaagtgcggttaattattgcaatgattattgtcatgccactctttttacgtcgttggaaaaaaattgataaaccaatgcgtaaacagctttggtggttggcattctttaactataccgccgtatttttattgcaattcatcggactaaaatatacatccgcctccagtgcagtcaccatgattgggctagaaccgctgctcgttgtatttgtcgggcatttcttctttaagacaaagcaaaatggtttcactggctattcggtgcaatggcatttattggcgtggcaattttaattaatggcggaaaaaataatgaaggcattgataacatcagtttattcggctgtttattagtactaagtgctgggatcattttcgctgccgtattacgttggacacagcgagttgttgccaaagtttcaaacgcaagcctatacctccgtcagcattgtacttggcaccatcacaacattgccatttacgctattactcacagaaaactggcaaatatcattaaattctacgggtattgcaggtttattatatcttgccattggctgtagctggcttgcctattggttatggaataaaggccttaatagtgtagatgccaatatctccggtgttttagtcgcacttgaaccgctattcggcattttatttgctgtatcattacttggcgaaacgctatcattttcagccgcacttggtataacaattattatgttagccacacttggctcgactttactgccgaaacttttaaaaaaatcggtataatatgcccccaaaattttggattatcatcattgtgaaaaaaattgatcaacaaagtttagaaaatgcctaccgtttatttgaaagcggtgatattcatcaaattgaaattggttcaacaaaagggctgcaacaaattcatcattacctatttaatggtctttatgaatttgctggtaaaattcgtgaacaaaatatttcaaaaggtcattttcgttttgctaatgcactttatttaaaagaagcattaggaaaaatagagcaaatgccagaagatacttttgaaaatattattaataaatatgtagaaatgaatattgcgcacccttttttagaaggtaatggtcgttcaactcgcatttggttagatttagttttaaagaaacatttaggtaaagttgtcaattggcaaaatgtggataaaacgcaatacttacaagcaatggagcgtagcccaattaacgatttagaaattcgttttttattacaagcgaatttaacagatgatgtaaataaccgagaaattatttttaaaggtattgagcaatcttattattacgaaggttacgagaaagaataaagtgcggtaaaaatacgcaaaattttgaaaggaaaaacaaatggcttggattcaaattcgcctgaacagcaccaatgaaaaagcagaacaaatgagcgattttttagaagaaatcggctccgtctctgtaacttttatggatagtcaagatacaccgatttttgagcctttgccaggcgaaacgcgtttatggggtaataccgatgttattgcgctatttgatgcagaaacagatatggcagaaattgtccgcttattaaaagaagcgaaacacttagatagcaatacggcatacaaanttggancaaatagangattaaagaactgrgagcgtgagtggatggataacttccacccaatgcaatttggtaagcgtttatggatttgtccaagttggcgtgatgtgcctgatgaaaatgccgtcaatgttatgcttgacccaggtttagcatttgggactggcacgcatcctacaaccgcactatgtttagaatggctagatggtcttgatttaaaagataaaagcgtcatcgattttggttgtggatctggtattttagccattgcagcattaaaacttggtgcgaaaagtgcggtgggaattgacatcgatccacaagccattctggctagtcgcaataatgctgagcaaaatggcgtgacagatcgcctacagctgttcttatctgatgaaaaaccctctgatttaaaagctgacgtcgtggtggcaaatattcttgctggccctctcaaagaactttacccaatcattagccaacttgttaagccgaatggcgatcttggtttatcaggcattttagaaactcaagctcaatcggtatgcgatacctatacgcaaacatttgcgttagagcccgtcgcggcgagagaagaatggtgccgaattacgggtaagctaaaaacgctttaatttctttttgtcaatcaaaaaaagtgtattttttaaacaaatttcactttgcaaagcaaggcaaaatgccgtattaatagccagccttgtcggttgtcgagcagttcgatataaattagatttaggcttgctaggaaaggaacgtaaaatgcgaatcggttcataccaattaagaaatcgtgttttacttgcaccaatggcaggtattaccgaccagcctttccgccgtctttgtgcatattatggtgcggggcttacattttcagaaatgatgtccacaaatccgcaagtttggcataccgaaaaatccaaattgcgtttggcacatagcgaagatttaggtctcaatgcggtgcaaattgcaggtagtgatccactcgagatggcgcaagccgctgctattaacgtggaatatggcgctcaaatcattgacattaatatgggatgccctgccaaaaaagtaaatcgcaaactcgcaggttctgcgttgttgcaatttccagatttggtggaaaaaatcttgcgagaagtagtgtccgccgtcaatgtgccagtgaccttaaaaattcgtacaggctgggataaatctaatcgaaactgcgttcaaatcggcaaaattgcagaacaatgtggcatacaagcattaacggtgcatggtcgtacacgcgcttgtctttttgaaggcgaagcggagtacgataacattaaagccgttaaacaagcaattgctataccagttatagctaatggcgatattgattctgctcggaaagcaaaattcgttctcaattatactggagcggatgccattatgatcggtcgtgctgccttaggtaacccttggttatttcaagctgtggaaaacctaattgagcataactcgataagtcaaatgccaagtttaaaagaaaagtgtggtcagattttgcgtcatattcaagaattgcatcaattctatggcgaacaaaaaggctatcgcattgcgcgtaaacacgtagcttggtatttacagggaattcaacctgattccgtttttaaacagacttttaatgcaattagtgatcctaaagagcagctgattgtattggaagattttttcaatttaattttggataaaaaaaatgttagaacaacaacgtaattctgccgatgccttaacggtatcagtattaaatgcgcaatcacaagtgaccagcaaaccattacgcgattcagtcaaacaagcgttgcgtaattatttagcacaattagatggtcaagatgtgaatgatctttacgagctagtattagcggaagttgaacaccctatgttagatatgattatgcaatatactcgtggtaatcaaactcgtgcagcaaatatgcttggtatcaaccgtggtacattacgtaaaaaattaaaaaaatacggtatgggataaggcgatattcttttattaacaaaaagattgaatgtttttcattctattttaaaaattagccccaagtaatttggggctaatttattattacaatttaagatcttcgatgtgcatttttcataatgcgatcttttgttactttccattcacgttctttaatatcatcacgtttatcctgttgttttttacctttggctaaaccgattttgacttttgcccacgcacttttccaataaagagaaagtgcaactatggtaaaaccgtctcggtttgctttaccaaatagggatgctaattcgcgtttatttaacaataacttacgagtgcgagttggatcacaaacaatatgcgttgatgcaacatttaatggctgaatgcttgcgccgaataaaaaggcttcgccatttttaaaaataacataactatcactaatatttgccttgcctgcgcgcatagatttgacttcccagccttgtaattcaagacctgcttcaatttcatcttcaataaaataatcgtgtcttgcacgtttatttagtgcgatagtatttgaattgggttttacttttttctttgtcataattttatcccttattttgcctgaggcattttatcggatctctattttgatagcaaaaagatcatctaggtagaactggcagtcgcatttattttcaatctttaaaaataaatgatttgtagaaaataagagaaaaactgaccgcactttttaagaaaaaacagacacattgttgtgtctgtttgggaaagataaaaagatgaattaagtgttagcgatttatatagtgaataaaggattattccaaacgttttgccactttaagccaatcagccttaaatacacgctgcatattattaatggcatcaataatatcgtgatgaacgagttgttcattttggatacctacgcaatagccgcctttgccttgtagcaataaatctactgcgtatgcgcccatacgtgaggcaagaatacggtcaaaagcacaaggagaaccaccacgttgaatatgccctaaaacagttgcacgagtttcgtgtccaacgcgagcttcaatttcttttgccagagaatgaacatcggttaaaagttcagtgatagcaataatagcgtggcgtttaccgcgaataatgctacgttcaatttgttgaattaattcttcacgattaaattcaatttctgatgcgacgatatattcacaaccgccagcaatgcccgcagaaatggttaagtcactacaatggcgacccataatttcaacgatagaaatacgttggtgtgagcttgatgtatcacgtaaacggtcgattgcatccactgcagtttgtaatgcggtttgataaccgatggtatagtcagtacctgcaacatcattatcaatagtaccgggtaagccaacacaagggaaactgtgttcttcggttaataattttgcccccatgtaagaaccgtcaccaccgataaccacaagtgcatcaatgccgtgagaacgtaaaatttccgcacattttgcccgaatattaggatctttaaattcaggaaaacgtgcagaacctaaaaaagtaccgccacgattaatcacatcagatacgctatagcgatttaattgtttgattttattattgtataaaccttgataaccgtcatagataccaaatacttctaagccttctgcaagtgcagaacgtactacgccacgaattgcggcattcataccaggcgcatcgccaccacttgttaaaactgcaatttttttaatcataatttacctacttttaaccataattgaaaatgggcataagattacatcattcaaagaatctgctctagcaaaatttgacgggattttgatctacattatttttcacaaaacagttgccatttcaaattttgtaaatgctttctttctatatccacaatgtatttttgcaaatgtcgttgtactttattgacagataaatgtttagaacgcgttggttgctgtattttctgcgaatattgaaattgcacaaagccacattgggacaattgtcgtcctttcatcacattgacttgccaagatggattttctttcgttggcgaatagataacatatccatttaattcatttggattggtcgaattttctggaatagcatcgaaatggaaatcttttacgcctgtattgcgataaatgcgttctcttaatgcaatacgttctttaatagaacgttcgggttgattgcgatcaaagagaatttcaatttcagattgccaattttccagcgtatctggtttagcaatatacacatagcgtgcaatggtttcgaaatcttggctgccagtaagtacataatgttttccattatattctaactgcgtaggcacatttaattgcgtcagcttagttgcacagcctgaaagtataagtgcggtcaaaataacaaaaattttattcattaatatctcgcttaaagacaaattcagtttcagtggaggatgctgaatcaaaccaataaccacctaaatcaaattcttttaactgttcaatttcagttaaatgatgttgaataatatagcgacacattaagcctcgcgcttttttcgcataaaaactaattactttgtatttgccatttttattatctaagaaaactggcttaataattttagcgttaatttggctttctttaacagatttataatattcgtcagaggctagattgactaacacattatcgccttgttcatctatagcttgttgaaccgcttgggtgatcacatttccccaaaaggcatacagatcttttcctttcggattggctaattttgtgcccatttctaatcggtaaggttgcattaaatcaagtggttttaaaagcccataaagaccagaaagcatacgtaaatgggattgcgcaaaaatgacatcatcttccgaaagggaatcagcatctaaaccagtataaacatcgcctttaaatgcaaagagtgcagggcgggaattgttttcattgtgaatttttgtccattctgcaaagcgtgcagcatttaaaccagccaacttatcgctgatagacattaatgatgaaagatcttgtggagaaagtttacgacaaacctcaataagttgttcgctgtaatcggtaaagtgcggttgagaaacaggaaaattttttaccgcactttcaaaatcaagggttttggcaggggagataatcgctaacataatcgtccttttatgaaaaaaagaatgggcgtatcttagcataaaaatttacgctaaacgcgtttatataacccattttcacttatgataagatcttgcaactcaagatcgagcaactgaacaagcaaaacatcgacgcttaaattaaattcttccgctaaatcatcaatgctcactggcgtgtaaccaatacgcgaataaagtttcgggtggcttggtgcttctactaatcgacgaggatcaggtggtggcgtgtaattaggcacggcgatctggtcaaaatcaatttcagtttggctatggattgaatgttggtagagagtttccaaaatgtcctttgcattttctaccaacattgcaccttgtttaattaggcgatgacaaccttgacttgatttattttgaatgtttcccggcacagcaaaaacctctcggttttgttccaacgcatatcgcgcagtaataagcgagccgcttttttctgtggcttcaacaacaagcgtgccgactgaaagcccgctaataatccgattacgacgtgggaaattagcggcaatgggggcttggtttggtaagaactcagagactaatgcgccattattttcgatgatttgtgccgataatctttgatgtttagagggatagatttgttctaatccactgcctaaaaccgcaatagtttgtccttgaatattgaccacagcttgatggcaatgtccatcaattcctaatgcaagtccactagtaatcgtaaagccagctaatgaaagttctgtcgcaaaatgttttgcccaatattctccgtaagtcgtgcaataacggcttccaaccattgccatttggcgttgtgaaagtgcggttaaatttccttttacaaataatagtggcggaaaacttgcggtctgtttcaacaaaaagggataaaaaggggaaaaataattcactaaatgatttccctctttttgtgaccacacaagtgcaggctcaataaattttgcttcaggcttgaaccaacggcgaatttggatggctccccaccccatttgtcggaaagcaacatcatcataattaagtaattcatttaaggtaatattggacaaaattttatcaatgccaacgccgccaagtttaggcacttgcattaaacggagtaatgtgtaggtaatgtcattcatattttttcctttttatttgaaaatctagtatggaaaaaacgagggagagaaacgattaatttaaaagcattttgcgatgcagatcgcaaaaattctttttaatgaataaaaaattgcaaaatttttcttattttgaaaatgtaaaaaatccaataagaaaaatttgttgattagggttgtattggttaaatatgctaattttattaagtttattagttaaatgtatatttgatgaagtgtaagtaggtttatttttaatataaaatgccaaaaaatagtttgacagccagttttttattcgtaatatggaaaacgttttacacagaggatttttatttatgtttcgtattgtttctttatctctcaacctactgctctcacattttgtgtgcggctaagttgtggataaaaaaacagtcagatgtaaatacccaattttaaacccgcactttataagttgcgggttttttatctaaaaaatacaggaaaaacgcaccgcacttttggagtgattttagaggaacttttagtaaggacatttagtaaggacattgttatgacagatcgcgttattatttttgataccaccttgcgtgatggggagcaggcattaaaagcaagtttgacggtaaaagaaaaattacagatcgctttagcacttgaacgcttaggtgtggatgtaatggaagtagggtttcctgtttcttctcaaggggattttgaatctgttcaaaccattgctcgccatattaaaaacgcgcgtgttgctgcgttatctcgagcggtagataaagacattgatgccgcatacgaagcattgaaagtggcagaagcattccgtattcatacgtttattgcaagttccgcattgcacgttgaagcgaaattaaaacgttcttttgatgatgtggtaggaatggcagttgcagcagtgaaacgcgcacgtaattatacggatgatgttgagttctcttgcgaagatgcaggccgtacaggcattgataatatctgtcgtattgttgaagcggcaattaacgcaggtgcaactacggtaaacattccagatacagtcggtttttgcttaccaaatgaatacggcaatatcattgctcaagtgcgtaattgcgtgccgaatattgataaagcagtgatttccgtgcattgccacaatgacttaggtatggcaaccgctaattctttaacagcagtacaaaatggtgcgcgccaaattgaatgtaccattaatggaattggcgaacgtgcgggcaatacctctcttgaagaagtggttatggcaatgaaagtgcgtcaggattttatgggtgtggatacccatattaatactcaagaaattcaccgtgtcagccaaatggtaagccaactttgcaatatgccgattcagccgaataaagccattgtgggctcaaatgcttttgcccattcttctggcatccatcaagatggtatgttgaaaaacaaaaatacttacgaaattctgtctccagaaaccatcggtttgaaaaaagaaaaattgaatttaaccgcacgttctggtcgtgcagctgtgaaaggtcatatggcagatatgggctataacgaacaagattacgatttggataaattgtatgacgagttcttaaaattggcggataaaaaaggtcaagtttttgattatgatttggaagcattggcgtttatcgatatgcaacaaggggatgaggatcgtttggtattagataaactttcggcacactccaccaaagaatatccagcaactgcgtttgttcaattgaagttggatggcgaaaaattaagtacgtcttcaattggcggtaatggtccagtggatgcggtttataacgccatcttaaatttaacgggtttagaaatcaaaatgtctcactataacttaactgctaaaggcgagggcgcagaagcattagggcaagtggatattgtggtagaacacaaagggcgtaaattccacggcgtcggtttagcgacagacattgttgaatcttccgcacttgctttagtccacgccatcaatgccatttatcgagcgcataaagtggcagatattaagaatcataaacatcattaatttatcgagttcccctttttagcaaagaggggaaaaatacaaaaaaactaaccgcacttttgaagtaaaaaataggaaaaataatatgcaatcatacaatatagcagtattagcaggcgatggtattggtcccgaagtcatggcggaagccattaaggtattaaacagagttcaagaaaaatttggttttaaacttaactttaacgagttttttgtcggcggcgcggctattgagcattgcggttatccgttaccagcagaaaccttaaaaggctgtgatcaagcggatgccattttatttggttctgtaggtggccctaaatggacaaatttaccaccagatcaacagccagaacgtggtgcattattgcctttgcgtaaacatttcaaattattctgtaatcttcgtcctgcaaccctttataaaggcttggaaaaattctgtccattacgtgcagatattgccgcaaaaggttttgatatggtggtggtgcgtgaattaacgggtgggatttatttcggtcagcctaaaggtcgtgagggggatggcgtacaaaccaaagcatttgatacggaagtgtattacaaatatgaaatcgaacgaattgcacgtgcggcttttgaggcagcaatgaaacgcaataaaaaagtcacttctgtagataaagcgaacgtattacagtcttctattttatggcgtgaaactgtgacagaaatggcaaaagactatcctgaagtgactttagagcatatctatatcgacaatgccaccatgcagttaattaaatcacctgaatcttttgatgttttactttgctctaacattttcggcgatattatttctgacgaagcggcgatgatcacaggttctatgggaatgttgccatctgccagcttaaatgaagagggttttggtttatacgagcctgcaggcggttctgcccctgatattgcaggcaaaggcattgctaacccaatcgcacaaattctttctgcggcaatgatgttgcgttatagcttcaacttaaacgaagcagcagatgccattgaaagtgcggttcaaaaagtcttggcaagtggtcatcgcaccgccgatttggccgatgattccacaccagtttcaacggcagaaatggggacattgattacacaagcaatttaatacttgccttcctccgtttacgggggaaggtgcctgaagggcggaagggggcaatctccacccttagttatttagaaatatccccaataaacaggggggacaaagtatttaaagtgcggttgaaaaacacatcgaattttaaccgcacttcccttaacgaatagagaaaaatattatggcaaaaacactttacgaaaaattatttgattcacacattgtgtatgaagcagagggcgaaacgccaattttgtatattaatcgtcatttgattcacgaagtaaccagcccgcaggcctttgatgggttacgcgtcgcaaatcgccaagtgcgccaagtgaataaaacttttggcacaatggatcacagcatttctactcaagtacgagatgtcaataaacttgaaggtcaagcgaaaattcaagtgttagaattggataaaaataccaaagcaacaggtattaaattatttgatataacaactaaagagcaaggtattgtacacgttatggggccagaacaaggtttaaccttacccggtatgacaattgtttgtggcgattcacacaccgcaacgcacggtgcatttggtgccttggcttttggtatcggtacttctgaagtagagcacgtattagccactcaaactttaaaacaggctcgcgcaaaaagtatgaaaattgaagtgcgtggtaaagtcgcatcaggtattacggcaaaagatattattcttgctattatcggcaaaactacgatggcaggcggtacaggacacgttgtagaattctgtggcgaagcgtccaagacctttctatggaggggcgtatgaccgtctgtaatatggcaattgaaatgggtgcaaaagcaggcttgattgcgccagatgaaaccacatttgcatatttgaaagatcgtccacacgcgccgaaaggcaaagattgggaggatgccgttgcttattggaaaaccttaaaatctgacgatgatgcacaatttgacactgtggtaacgctagaagcaaaagacatcgcaccacaagtcacttgggggacaaaccccgggcaggtaatttctgtgaatgaaaccataccaaatccgcaagaaatggcagaccctgtacaacgtgcttcggcggaaaaagccttacattatattggcttggaagctggcactaatttaaaagatattaaagttgatcaagtgttcatcggatcttgcaccaactcgcgcattgaagatttacgcgcagcggcggctgtgatgaaaggccgtaaaaaagctgataacgtaaaacgtattttagtagtaccaggttctggcttagtgaaagaacaagcggaaaaagagggcttggataaaatctttattgccgcaggtgcagaatggcgtaatccaggttgttcaatgtgtttaggaatgaacgacgaccgtttaggcgaatgggaacgctgtgcttccacttcaaaccgtaactttgaaggtcgccaaggccgtaatggacgcacccatttggtaagtcctgcaatggcggcagcggcaggagtgttcggtaaatttgttgatattcgtgacgtaacattaaactaaggctcaaaagaggaaaaagaaaaatggcaggatttaaacaactttcaggcttagtcgtaccattggatgcggcaaatgtagataccgatgcaattattccaaaacaatttttacaagccattacccgcataggtttcggcaaacacttattccacgaatggcgttatttggacgtagaaggcaccaagccaaatccagaatttgtcttaaattatccgcaatatcaaggtgcaacaattttgttggcgcgtaaaaaccttggctgtggttcttctcgtgaacacgccccttgggcattagcagactacggctttaaagtaatgatcgccccaagttttgcagatattttctataacaatagcttaaataatcatatgttaccgattcgtttaagcgaagaagaagtagaagaaatcttccaatgggtatgggcaaatgaaggcaaacaaatccacgtagatttagaagcgatgacggtcactgtaggggataaagtttatacttttgagcttgatgaattccgccgccattgtttgctaaacggtttagataatatcggcttaactcttcagcacgaagacaaaatctcagcatacgagaaaaatattccagcgtttttacgttaaaaataaaaaatgcgctgatttttcaccgcacttaatcactgaatttcattcaaaaataaagccctgtaagacacagggctttgttgtttataacgttaattcaaacaggcttattaaaaactaaaacttagttttaattctgcagttttttgtttttccgcttgtttcgcttttgttaatccgcctattagacttaatttcacattatgatatttcaatttaagccctgcgttatattgctgttggttttccacgttgtaagcaaaatcatattgatttacattaatttttccgctgccttgatttgtatcatatcgagcagacaaaattggcgtaacggaaaactcgcctaagtgataagtataacttaaatcaacttgagcaaaggctgttttgacagatattggatttactttaatgcgatctttagctaatgcaaaattagcgtttgataaatagctataacgcacgcctactattggcgtaataccaaaattgccaagattaaatgctttgcctgcggttaaaccaaattgtgcagtatggcgagcaaatttcgcattatgattggtttttaggttgctttggaacttgccgtagcctaaatcaatgcccaaataccaatgattatccgcataatatttagaatagaaattaacttgtgctagagtatttttactgcttgccttatcaaagttgttactattgcgaacataagtaaacacgccacctaactgaacattgtttgagattgtttgatcccaaccaagttgagtttgcgtacttttagaactaaaacgacgatattgacttgaggaataattttcgttcattgaagtattagatacccaaacgttatattgcccctcgttattcatttctaactggctaatatgttgagaaactgctttccccacatttaatgcaacaaattgtgcttttgccattgcatcagaaattaccgcatttgtgtttgtacttgtgagatcgcgcaatgctactgtagaacgatcgctgccatttgtaacagttggttccgagcgaacacttcttctacttctacgatttggcttactgcgttttgaattatcagctattgttgtttcgtcagtagaagctgctgttgtttcttcagcagaagtctcttgaggctggctaatacttcttctacgtctactctttggatcactgctttctgaattatttgctacagaattatccgcaacagtattcgctttatgctgactagcatcttcagtcgaagccgcagtttccgtttgtggtttatcggatttttcagcagtttctgttattgcggttgcagatccagtatttattgaattctctggtgcaggttgtttagtgcttactgttgcacttgtttgtgtttgcagttgagcttgaacttcttctgcattattaacagtcggaacattttcactttcaagcactgcttgcggttgaacagtttcagactgttcctgtttcggagacgcttgagaagccacttgagggggttcttgagttttctctgtttctactttagccgttttctctctttctgttggttggtcggtcgtattttctgtttgattttttgatactacaggcgttacaggttcagcgttagttttttcacttggttgagtttcttccgctggtttactgtttggcgaagttgcctctgccgcagcaacagttgtcgattgtgtttgcggttgagcttgaacttgagtttcttctactttcgtatcagttgaaacttctttaggagcaggctttgcttgtttcggagacgtttcagaagccatttgaggtgcttcttgaatttcatctttttctactttagccttttcctctttttctactttagctgtttcttttatttcagtcgtttgagtttcctcggtttcacttccactttgagccacttcatttgtttgagtattagcttttacacttggtttagcttcttctgcaacttctccattttgagctgttgtctcggttgcgtcttgctcgtttttctctactgttttactttcttgcttactattttcagccactgtttcagttgtctctgatggtgtagcaggcgcaggtggtggaactggtgtttcaacacgggctatttcttcattgttacttggtacgctaggcacatcagcttgaatattattaggtgttgtgatatttgtcgtatcgacagtttgatttcttttttccacctctgggttatacaaatcgtaacgtccattaacattacgtaatttatatttccaagcacctaaatcaacggtattcccaactaatgacacattcaaattatttcttgtagcatttgacgcatcaaaaagcgtgagttcattttttgtaggctcgcctgttttatctgccacttgtaatgtaaagttacctgtggcggatttagttacaacaactttgtcgccttgtttattggaaagatcagttaaataatagaaagaaccgttacctgataagctattcacagtcagcgtgttatatgtagttactttatttgcatcgttttgtgcatttaaatgaatatgccccttgtctaaatttaactgattaacattgctatcgcctgttaaatgccaatggctattttcggttaaacgtacttggctatttcccgtgccgctaattgtgccgaataagttagctttgcctaagacaaagtttgcattacctgataaatttacattgccagatacattggtggcgttaaagctattaagggctttatcggataacttgtcagtagtgcaagtcacatagcccgtatagtcagaacgtacacaaacggtatcgcctgctttatagccaatatgtacttttgcattatcagaagctgtgatatttgaagtaatgtttgcaacattgcgacctgaataaagggttgcgttattggttacattaatatttgttgctttaaaattgcggttaatccagtcatcttctactaccacttcattattttcagcaaagtgttgatctttttttgtcgaagaaatacctgcaatatctcttgcgtgcggtgttggtctgccagaaaggaataatgtgcctttttcaacctttaaatcgccattaaggtttgttccgcctgttaataaaaagcgattttgctcacttttgcctttaaaagtcacatttagattaccgttatttttaccctcttcctcgccaaaataaccgttaaagccattcatacgctcgttgttgatatggttcattacatttcttttggcttcatcggaagttttacccatatatagccaattttcattgctttcgccactatttttaggtaattctgaacgagtgctcgcaccttttcttaacgcataataagtgtaattttccaaatttaaatagagctgtcctccatctttaatccgtcgaaaggcataaggattatcttcatctggtgcgtctatattatatggagtaattgtatttggatctgtaattagactttccccagtaattgttacagtagaggttttgctggtattgtgatttactagtcttgcgccatcatcaatattacggatatgttcaaaagtgagattattgccattggcatctaatcgaccacctctaaagccaaagtaaatggaatttggatctacttgcttatcatcattaagtacaacagttgagcgaccacttactatacctacttgtgaaaaggctttaactttattattggcatcagcttgttgttttaagataacagtaccatcgcccacttttagcgaacctttattttctccctttccttctacaattaatgttcctttgccgattttagctaaacgatcagatttcgggttatgtactttccacgttactgtttttccatcagcaacagaaacgccagctcctttccaagtggtactatcagaagtgcctttaacttcataatctccttcaaagaacaagccgcctgcgccttgatcgatattattatttaaggtaagcgttccacttcctctaagagtcacactttttccgtgattgttcttcttagagtcagtatcctgactactatcgaataaatcaacatttagagattcagaaccattagaaataacgcttgttttgccagtaggattccaattgtattgggtgttagaaccagttaaagaacctgcagtatctttatctagaacagtttttgcaaattcaggtttataaatattccattcttgccaagattttttgttataacctgcccaaaaatcataagacccaagraaaagccattttcctttttctctatcatatacaaataatggggagccactgtcgcctaaaacagcataattggtaagcggatcttgagataatattccttttggatcgctgtgttcctcttttgaattgccaaaaccaattagtccattattttcgtggtttactttataaggtgtgcctgcaataccataggtataggcatcgcccaccaatttaagattattgcctccaacctcatgattatttaaaattaagctgtaattatctccttttttataaataaattgactaccacttcctagtcttacaaaagcaggatatttattctgatcattatatgtgccagcatcactacttgcagttgaagcctctattggtgcaacttcggtaacaaatttatcaagacgtggcatatagtagtcttcacggcgtttttgagtttgatcttcagtagttactgcttttccattcaatttagttggatactcatttttctcaacggaaaaatatctattttcttctgaagatacatctcggtgcgatttagcattgccattattcatattgccatttaagttcccaaaatgtagttcactcacgccgttactaacgtgttttacacctactacatattgtggatttatcaatgtggcgatgcgtttatctacatccacaacactaaaatcaatcatcggaatgccattaggtaaaacattgcctaaagagtggttatttttatctctcacttccacatttgttgcaccaacagaaaatctccctttattttctgcaaaatcacgaaatatttgataatccacatcgtctctcactaacgcagcttctgtataaggggttaatgcgtaggcgacagtaagcgcaataaaattgagtttgaattttttatttagcatagaagctgtccttattaattaagtttaaaaagtagatttgataggacacaatttgatatacggttacaagttgattcaaattttggctgtgttgcgttgataatttgcaagttgtcttcatctttataatgagcgagctttatagcataaatcgctcaaaacttgaattacatttatgaggtaatgataataatttttgatattttttaaaaaattggcgtattttccaccgcacttttggctaatttaaggcgttaatgatgccattatgaacagaaaacatttttttattttccacttgcatttcttttagttgtctttgcgtaatggcggtaacaaacacttgtgaaccgctttgttgtaatcgttctgccaacaaggcacgtttgtattgatctaattccgaggcaaaatcatcgatcaaaaaaatacaatggcgttgcttttctttcattaaatgctcgccctgcgctagtcttaatgcacacattaaaagtttaagttgtccacgagaaagcacatcttccactggcaatccttgtgctttgaaacgaaaatccgctttttgagggcctgaaaaggtgtaatttaaggcacgatctcgttcaaaattttgttgaagaatttcataataatcagcatttttttcccatccttgatgaaagctgacattaatttctaattcaggcagaaaaagttggcaagtttgctcaatttcagggctaagtgcttctgcgtattcggcacgccattcacttacttggtgggcaagtttagcaagttcaacgtcccaaatttttatggcagagtaaggctgattttgtgcaagggcggcatttcgttgtttgagtaatcgattgagattgctccaagcggaatagaaacttgtttggtgatggaataatccccaatctaaaaacgcgcggcgataacttggcccgccgttgagtaaagttaagccctctggcgtgattaattgcattggtaaaagatgggcgagatcggaaattttattgccatcttcgccgttaatttttactaaggtgttgccttgacgcagtttttgtaagccgatagaccattgatgttggctttcttggatttgtccaaatagggtaaagtgcggttcgtcgtaagaaatgatgcgatttgtgaccgcacttttaaatgaacgtccgtgaccaagataaaaaatggcttctaataagctggtttttccgctgccgttgttgccgattaaaaagttaaagcagggatcaaaatcaagatccactgctgttaaattacgaaatttttcgaccagtaaacgagaaatcgccatattataaacgcattggcataatgacgtattcgcagctgctgtcttcacagttttcaattaagcaactggagaacgcatcagttaagcacattcgcacttgattacatttaagtgcattcagcacatcaagaatataggtcacattaaagcccacttctaattcttcgccattgtaattgacatcgacaatttcttctgcttcttcgtgttctgtatttgaggcagtaattttaagctggttttcctttaaacttaaacgtacgctgcgtgcgcgttcattagataaaatagacgcacgagcaaaagcctgtttcagcatttcccaattgccttcgacaatttttgtggcattacgaggcaatactcggcgatagtcaggaaagcgaccatcaattaattttgatgtaaatactgtgttttttaaatggacacgtaaattgttggtgccaatttgtaagcgtgctggttcatcgtttgtttctaataaacgaacaagttctaacacgcctttacgaggtaaaatcacagaatgattttgtaattcttgttcaagtgagatagtacagaccgcaagtctatgaccatctgttgccacagttcgcaataaattgccttctgtttcaaacttcataccatttaagaaatagcgggcatcttggtttgccatagaaaattgagtggcttcaattaaacggcgtaaggtattttgcggtagttcaaaatccacttcagactgccaatctgtgaggttgggatattcttcggcaggttgggttgctagtgtaaaacggctacgcccagattgcactaatgcacgatcttgttcaaaagtcaccgtgatttctgaatcatcagataaagtgcggcaaatatctaagaatttttttgctggaatggtaaaagtgccattttcagaagatgatgaaagttgagtttgactagagagttcaacttctaaatctgtccctgtgatagtcagacgatagtcttcaatttgcaataatacgttgtttaatacaggaatatttgggcgattactcaatacgccacatacttgttgcaacggttttaataaattttctcttgaaatactaaattgcattacgttctccttttatgcggacaaagtgcggatcaaattcgcccaatcttcttgaatgctattgtcttgctcacggaattttggtacttctcggcaagcgtttaatacggtcgtgtgatcacggtcaaaggcacgaccgatttctggcaaactgcgatttgttaattcttttgctaacgccattgcaatttggcgaggacgagtcactgaacgtgcacgactttttgattttaaatctgaaaccttaattcgataatattcagccaccactttttgaatattttcaatggtaactaagcgttcttgcagagccaaaatatcttttaaggtatcacgcacgaaatcaatatcaatgtcaccgcctttgaagtcttgcattgcttttacacgatttaatgcaccctcaagttcacgcacgttggtacgcaagcgttgagcaatgaagaaagcgacttcttctggcaagttcatattatgttcttccgcttttttcaataaaatcgctacacgggtttcaagatcgggcggttcaatggctgttgttaagccccagccaaaacgtgattttaaacgttcttcaattttttcaatttctttaggataacgatccgaagttaagataatctggcgacctgtttcaaacaagctattgaaaatatggaagaattcttcttgagttttttctttttcagcgaaaaattgaatatcatccactaaaagcgcatcaagagaacgatagaattttttgaactgatccattttattatcacgcactgcttttaccatatgttgcataaagttatttgcgtgaatataaagcactcgtgcattcggtttatcggctaaaatgccgttgccaatggcgtgtaacaagtgagttttccctaaaccagtgccgccatataaaaagaaaggattggctgatggttcgcctggtgcttgagcaagtttttgaccgactgcacgtgcgagttggttcgatttaccttcaacaaagttatcaaataagtgtttagtattgagatgagattcaaattttactgaagcactagattcagcttgaaaatctaccgcactttctgatctaagtgatgtatttggtgtgctttccactatcttgggtgcaggtttaaccccttcttttaaagaaatacgcagttcaggattttgtgcaagtgtttgacaaatttgctggatttgtgcgagataatgagtttccacccaacctttcacaaacatattagaagcatataaaacaatgtggttatccgccaccacgtcagcctgtaaaggacgaagccaagtgctaagatcgctggctgaaacttgatcttgaagttgtaacaggcaactttgccaaagatttgagagattcacaaaaggatccttattgtttttgtaatagagaaaagtgcggtaaaaattgtcggagattttacaataaatgcgtgaaaagatcttctaaaaaatccaagtttgacctttcacttaagcagattatagaacagaaaaaaatgcgccagtattgtatagatatagcatatttaatctatctggcgcattttaatttagaatttcatttctaatgttaaggtatagtttcgtcctgatgctgcgtagcgagtatagttaccaacattttgatgttgattgaccgcaccttgtgctgtttgacgcaccgcttcccaagtaacataacgatagttgaataaattatatatccctaatcgaagcataatatttttattcgccatgtaataacccgatacatctaagatatgccatgcccgagtaagttttcttgttgattttacatcccttgaattgttacctaatgcacgttttcctagcaattcattttgagattttgcttttgattgggtaaaggtagcatttactccccaagtattacttatatgatcatagcctaaaccaatgatataacggctgggctgaatggcatcaaataaataactgcttacggaggctaaaccagcattgattttttgatctttaacttttactcggttataagcaaatgttgcataccaaccgtagggaatacgtttccataaaccattaaaatctaattgcgcagttatatttacaccaactaattttgcattttgtgcattatgatatccataattgccctttccagttccatttttactaagttcttcagcaaaggcgataagatttcgataagcattactaaaatgactgatctcaatattaccaaaatccccttttagagcgagaccaaactcttggttacgagatgtttcaggcttaaatttacctacataaacctcgtcattcttgccaccataccgccaaccatacatttcagcaaaactaggatttctaaatccagtagaaaggcgataagaaagatcaagccattccgttggttttatgacaataccagtattccaagagaaatttttaaatttaccaacactaatagttgattcattagcttttgtacgagatacgtcataccgaatacctaaacctaaatcaacgtatttccctaatgccatattattgcgtgctgcgaaataataatttttccctttaattaaccgcactttacagtctctgtaattagaggaactaccttgataattacaatgatcttctcctgcaaaatatggctttggttttgggtataagtaagggtattcgcgtaaaccatttcttcttgttttaccagttttatctgaaatactatctgccgtagcgataacacgtcgagttaaataatctttatgctgaagtgcggaagtaaagtcatcaaaaccaagattgaagacaatttgatgagtaagccaattttgttgaatttttttctctaaattcaattgcaacatattatgtttttctttataaacatttctatcagaacgatagtatgaataaggtttatcaagtgttgggcggcaattcttacttggattaggataaagactgcaatgcgtatgtcgcatataactgtcaagtatgatgttttgttgattagcacttaacactgctttgtcaatgatgcccgctttgttcttattttcgtaaatatattcaatacctacacgctgttttctatggtgttcatcgaaataaagcccacttgcatatttaacgcctcggccatcctcaatatgttgatatgcgccataatcttgctttggataaaaagggcgatttgctaaatcccctttttctgttgggcttaaataagcgggaaatgtcatatcacggatatcaaatttttgttgtgtgaattcaaaaataccaccaatataatgttgttcagaaaaatgataccctcctcttaaaaaccaagactggctttcatatttcattggattaggtttgatacggttagcccccgtataatctgaaacgcttacggtttcttttttggtggataaaatcgcaggtggtttggctgaaggtatacactcgtcataaccctttggacactcatcttccatcacaaagtatgcagattgattctctggtttggcgattaagcgattataactttgcacgccttttaatgcatctttatggacttgggtttcaattgaatttcgttgagtgtaaatagcaagtccttcaaatccaccttgttttcctgctacagctaaagaatgggtaaagcctttatttttgcttgaataagcatttttagtttgaattccccatgatttgtctccttctaagatatcggctgcggatttgctttgaaatgttacagaaccagctaatgctccatttccatactcagaagaactcccccccttgcttatttcgacggcctttacattttcatattcaatttcattaattgcaccagtgccagaatatcctgaacgagcaactaaagggctttgcactacataagattgcgtttgaggtaaaccatctaccaataaagcaactctatttctgtccataccacgaatagaatatccagaacttgcaccgcgaccttgttctacaactgaaatccctggatcatagcgtgttagatcacgaatatttaatacttgttctcggctgatactttcactagttttgataattttgccaagtccagttacttcattatctttacgatctcttactttttctgcagtgactgagatagtttctaattctgaatcttctgtactttgagtgtccacttcagatgatatagcttcttttgtatcttttatactttgagtttctgcttttacatagcatgaaattaaaagacaagaaataatacttaggcgaaaatagggttttttagtcatttttagtattccattatttggttgtttctacttgttgtttgtttctacttgttttttagctccaaacacaactgcagctcttgccttttctgaattggatggtgaagatgcggttggggaatttttatctgtaggattttttccgttataggtgaaataccctcctaattcagaagcattaggtccataaaatgccccatttactttagttgtaatattaattggggtatttttagtttgactatttttaccatctattactaaatcttttgcggttgctgtaccagtgaaggcattcccaccatttttaaagtttgcctcaatactaaatacgggattttgtgagtctgcacgttttaagctcccttttaatgttttctcggcaaaatttacatcaaactcggcgacagcatttttatcttgtcgtttatctcctgtagtggagtaagatgtctcgccatcactaatataaccaaaccaactaccgcgatatttcacgtttcccgttgtaggaattttagaactggcagtacggagacctaacaaaaattggtggtattgttctgtttcatttttgttgttcttcttattatcctcataatacataccaaatttcacatagcttagattcttgcaacatgcttctactttataggttttatctcttacctcataatgtttactcgttgcgaagtcaccactattttcagtttcaggtaaaagaggaacagggtaattatcaattaaaaggtaatcagcttcaccaaaacytgatatatctttcgtcgtaaagttttctgcattggttgttgcatcggtttttgcattggctgttgtactggttgttgcatcgggttttttagtagagaaagtagttagcttgccatcaattaaggtttctttgggtaatgttttttgttttgtttcttccgtttctttggcactaaataccccaaaaacttttttgtcgccagctaaaaactttcctcctaattcttcaccgttaggcccataaaaaccaccttctaatgttccctctctggtaaagggatgttcttcagaatctttttcggttggctttactttacccctgaatctattactataaatattggcatctatatcatagagttttttcttttcatagttttgattattagtttttcttttggtgtaaaacagttctcctttcagttttttagtcccaaaatctgcactaaattgacttattaatcccgtctcaccattattttgatcattttctaaatcaatgtcttctgaaattgcactacgtcgagaataaccttgaccgctagaattactgaacaaagaataatttttgcctctttcagttgcggtgatgaagctccaagttcctttatacgttssttcgccatttacaggtaatgtagtggctgtttgcttgccaaagtaatacgcatatccatagtaacctgaataaaacttgccatttgagaaattacgccacgattgaatataataaagacccgaatatacatattgctgtccatgatgattttggggtgaatttgtttcgctaggctcgtctattgagccaatagtgggttcctgagattgattttcttttttaaaatcatcttcaatcttagaaagtgaggaaaatatgatatagccatcttcatttaagagactaggttctctaccacgtaaattctgagcaactaacttcatccctccccctaaagaaggaatggacaacttttccaaattagatttttttctttgattcgaggtatcgtcttgataacgtggtttagaagaggagggattagagacgtcatctacatcaaaagaaccacctcccccgctacaagcacttaagaaaagggaaagtccaccagagataagaggtacagatttcatagaattatattcttatacaaaattgataattgttcgcattatcattttttttttgtaataatgtcaacttataattttttaagttcatggataaaatatgaaaaatggcgtaaaacaactttttctcttatcattaataggcttatcattaacgaatgtagcttgggcagaagttgcacgtcctaaaaatgatacattgacaaatacgattcaaagtgcggaattaaaaacctcctctttttcctctatgcctaagaaagaaataccaaataggcatattatttctctttccaaaagccaattagcgcaccatccaaggcttgttttgcgtgggttaattcctgctttatatcaaaataacactcaggcagttcaactgttattaccactatataaacaatttcctcaacaagataatttcttactaacttgggcaaaggctattgaagctcgtgaacaaggtgatttaactcaatctattgcttattatcgtgaattattcgctcgagacgcatctttactacctttacgttattaattagctcaagctctattttttaactatgaaaatgaagctgccaaaattcaatttgaaaaattacgtacagaggtagatgatgaaaaatttttaggtgttattgatcagtatcttttaacactaaatcagcggaatcaatggatatggcaagtaggattaaattttttaaatgatgataatttgaataacgctccaaaaagtggcacaaaaattggtagttggaccgcttgggaaaaagaaagtgggcagggggtagggtattctttatcagtagaaaaaaaatggccatgggcagatcatttttttagtaaaactatgtttaatgggaatggaaaatattattgggataataaaaaatacaatgaggctactgtgcgtataggtggtggtttaggctatcaaactgcctcagttgaagtctcgttgtttccttttcaagaaaaacgctggtatgcaggcggtagctctggaacgaatacaatgaagcaatatgcggataaattgggtattcgtttagaaaacgtagattggctaagtaaaacttggcaaatttctaccgcacttgagtatggagaatctcgttataaaatccgaaaacatttagatggtaattattatttcgtttcatcaacattattttatttacctaaaagcacccaattttggtttgttggcatggattttcatagagaaaatacacaagcattagataatgcttatcaacaaaaaacattgagacttggttgggggcaggattggttttatggtatttcatcacgtcttacttttagttatgccaaccgagtgtatagagagaaagatttgattggtatacagcaaaaaaatcgtgaatacacaaccacaattactttatggcatcgaaatatacattttatggggctaacacctaaattatcgtgggattatcaaaaatccaccagtaatcatgctttttatcgttatgataaaaatagaatttatctcgaaattggaaaaatattttaaggctgaaaagttgtaacctaacttttgaggtatctctaactttagcaaagtgcatatattttttaatattcgtttgaagttttttttaaaaatttccgtttcttatttgacgaacgcgtattttatgactagaattgcgctctattttattcactcttaattgtatttaggtaaattaaaatgaaacgtacatttcaaccttctgtattaaaacgtagtcgtactcacggtttccgtgctcgtatggcaactaaaaatggccgtcaagttttagcgcgtcgccgtgctaaaggtcgtaaaagtttatctgcataatcacaattcacaattcttagtggttaagctgaacttttcaagggagttacgtttattaactcccattcaattcaaaaatgttttcgaacagccattcagagctagtactcccgaaattacaatccttgctagaaaaaataatcttgaacatccgcgtttaggtttgaccgttgctaaaaaacatttaaaacgcgcccacgagcgtaatcgaattaaacgcttagtacgagaaagttttcgtttatcacagcatcgtttgcctgcttatgattttgtttttgtagctaaaaatggtattggaaaactcgacaataatacatttgcacaaatactcgaaaaattatggcagagacacattcgcttggcacaaaaatcttaattaagattatccgtctttatcaaataatgattagtccgtttattggggctcgttgtcggtttgtgcctacttgttcttgctatggtattgaagcattaaaaacacacggattattaaaaggtggttggcttacgctgaaacgtgtattaaaatgccatcctttaaacgcaggtggattcgatcctgttccaccaaaaaccaataataatgatgagaaaaaataatggactcaagacgtagcctattagtgcttgcactgatttttatttctttccttgtttatcagcaatggcagttggataaaaatccacctgtgcaaactgaacaaacaacttcaataactgccacttctgacgttccggcaagttccccttctaattcacaagccatagctgattctcaaactcgtggtcgtattattactcttgaaaacgatgtgttccgtttgaaaattgatacattgggtggcgatgtaattagctctgaattattaaaatatgatgcagaattggattcaaaaacaccgtttgaattattaaaagatactaaagagcatatttatattgcgcaaagtggtttaattggtaaaaacggtattgatactcgttctggtcgtgcgcaatatcaaattgaaggcgataattttaaattagcagagggtcaagaatctctttctgtaccgcttctttttgaaaaagatggcgtaacttatcaaaaaatctttgtgttaaaacgtggtagctatgatttaggcgtagattacaagattgataaccaaagtggtcaagccattgaagttgagccttatggtcaattgaagcattctattgttgaaagctctggtaatgttgcaatgcctacttatactggcggtgcatattcttcttcagaaactaactataaaaaatatagttttagtgatatgcaagataataatctttctattgatactaaagctggttgggttgcggtgttacaacattatttcgtttctgcgtggatcccaaatcaagatgtaaataatcaactttatacaattacagatagtaaaaataatgttgcatcaattggttatcgtggttctgttgtcactattcctgctggtagccaagagacgattacaagttcattgtggactggccctaaacttcaaaatcaaatggcaactgtcgcaaataatttagatttaactgttgattatggttgggcttggtttattgctaaaccgttattctggttattaacctttattcaagggattgtgtctaactggggtttagcgattatctgtgtaacaattgtagtgaaagcaattttgtatcctcttacgaaagcacaatatacttcaatggctaaaatgcgtattttgcaaccgaaaatgcaagaaatgcgtgaacgttttggagatgatcgccaacgtatgagccaagaaatgatgaagctttataaagaggaaaaagtaaatccacttggtggttgtttgccaattcttcttcaaatgccaattttcatcgcattatactggacgttcttagaagccgttgaattacgtcatgcaccattctttggttggatccaagacttatcggcacaagatccttattacattctccctattttaatgggtatctcaatgttcttgttgcaaaaaatgtctccaacaccagtaactgacccaacacaacaaaaagtaatgaattttatgccattagtttttatgttctttttcttgtggttcccatcaggcttggtattatactggttagtatctaacttgatcactatcgcccaacagcaattaatttatcgtggattagagaaaaaagggttgcattctcgtaagaaatagtcacgaacaggcaaaaagaaaggcacggaatgtgctttctttattatttgatcttaatatattctgcattttgtagagatagagtttttttagtagaaacagggataagccttatccctctaaattaaaagtgcggctagattttaaagagttttttatgaaagaaacaatcgttgctcaagctactgcaccaggtcgtggtggtattggaattttaagagtctctgggcctttagcaacaaaagttgctcaagctatattaggtaaatgcccgaagccaagaatggcagattatcttccttttaaagatgctgatggcactattttagatcaagggattgcgctttatttcaaatcgccaaattcatttactggtgaagatgtgttggaattgcaaggtcacggtgggcaggttgtattagatttattactcaaacgtattttacaaattgatggaatccgtttggcgagaccaggcgagttttctgaacaagcttttttgaatgataaattggatcttgctcaagcggaggccattgcggatttaattgatgcaacatcagaacaagcggtacgctcagcattaaaatctttgcaaggtgaattttctaaaaaagtaaatgaattagttgattctgtgatttacttacgtacttatgtagaagcaagcattgactttcctgatgaagaaatagatttcttggcagatggaaaaattgaagcaaacttacgtggtattattaatcagttggaagatgttcgctctgaagctaaacaaggttctattttacgtgagggaatgaaagtcgtgattgctggtcgtccgaatgcgggtaaatcgagcttgcttaatgcgcttgctggtcgcgaagcngctatcgtcacggatattgcaggtacaacccgtgatgtattgcgtgagcatattcatattgacggtatgccattgcatattattgataccgcaggtcttcgagatgcaatcgatgaagtagagcgtattgggatttctcgtgcttggacagagattgaacaagccgatcgtattattttgatgttagatagtagcgatcctgaaagtgcagatttaagcaaagtgcggtcagaatttttagcaaaattaccctcaaccttgccagttactattgttagaaacaaaattgatttaaatggcgaacaagcaagtgaaagcgaacagggcggttatcaaatgattagtctttccgctcaaacgcatgatggtgtacaacttttacgtgagcatttgaaacaagcaatgggtttccaaacaggcatggaaggaggctttttagctcgtcgtcgtcatttagatgcgctggataaagccgcagagcatttacaaatcggtttggttcaacttacagaatttcacgcaggagaacttttagcggaagaattacgcttagttcaaagctatttaagtgaaattacgggtcaattcacatctgatgatttacttggtaatatttttagttctttctgcattggaaaataggaagcgtaaagtgcggtcattttttggcaaaatttaaatcaaaagcggcaatatttggtggtgttttgttgataggaattgctattagctggctttgtgaggatggagttttcactttttaagatgctaattttttacgtttagattataatcgggaaaattttatatttataacaagggttatagaatgttaattgaaaaaatgcacaatttaacaaactcaaagatttctaaatttatcttaggtttgattgctgtatcgtttttagttggtggaatgtctggctatctttttagctcaaatgatacctatgccggcaaaagtgaacggcgaagtaatttctcaacaagattttttaaatcgctataatcaagagtttgaaatacgcgcacaacgtgagggagaggcgtttgtggctcagtctgattctcctgaatttgttaccgcacttcgtcaaaacatcgttaatctaatgattgatcaagaattacttcgccaatatgttaaagaattaaaattaggcgtgagtgatgaaatgattaaacgtgcaatcgtgaccgatcctaattttcaagtaaagggtaaatttgataatgctgtttatcaacgaatattacaacaaaatcatttaacttcagatggttacgcttcaattttacgtgcttcgttacctcttgaacaaatacaaaatggcgttgctaacagtgaatttattgttcctgctcaagtaaaaaatagcgcagaagttttctttcaaaagcgtttagctcgtttagcaactttatctcttgcagatgaaatggcaaaacaatcagtctctgatgatgaaatcaaaacgtattatgaagctaatcaaaagtcttttgttcagccagagcaggttaaagttcagtatattgatctttctgcagataacatcagtagaaatcttcaagttacagatgtagaaattgcgcaatattatcaagataataaagcacaatttatgactcaacatttagctcatattcaatttgcaaatgaacaagatgcgaaagtggcttacgaggaattacagaaaggggcaaatttcgctgatgtcgctaaagcgaaatctttggataaaatttctggtgagaatggcggggatttaggctgggtaaatgagaatgaattaccaaaagcctttgaagatgccgcagctgcattgcaggtagggcaatatagccaaccaatcaatgtggatggcaattaccatattgtgttagtgcaagaacgtaaagcgcaaagtttggagaatgtgaaagctcaaattgcagatttagttcgtaaatctttgatggagagtcgttatttttctttagaaaaacaagcgagtgataaggcttttgaagacagcaagtctcttaatactgcagcacaagcagcaggtgttaaggttcaagagagcgattatttttctcgtcaaaatgtgccagctggattaaatttccctaatgttatttacacaatatttgaatcagatactacgaatgttggtatgaattctgaaccaattaatgtaggcgattatcacacaattattgtacgtgtgttggatcgcaaagcagagggcgtaaaaagtttagaagaggctaaaatagatattgaaactttcttaaaacgtcagaaagctgagaatgcgcttaatggaaaagcacnacaagcagtgaaaaaattaagtgaaaaccctgaatcaaaagtagatggcattaatttctcaagtgagcagacttttactttaagtgaaaataaagatcctattttaacaaatggtatattttcaattgctaaacctgaatcaagtaaagctctttatcaagtggtgcataattcaaatggcgatgtcgttgttgtcgctttgaataaggttgaacaaggcagtttaagtgaaaaagaattgtcgcaatttgctatgcaattattgcgtagtcatcaatctgaattacaagttcagttaatacaaggattacgtgagagagcgaaaattgaggtaaatgattctttcatcaatcaagatgatgaagcacaacaatagtaggttaaattataatttgagataaattctgctcaaaagtgcggtaaatttcaccgcacttttttacttttgtgcgaaaggaagttaatgatgttcgggaaaaaaataattcattctaaaacaatatggttttattttttattgtttctcttttccatatttaccaatatgggattaggcaatgtattaagtgagaatattcctgtttcagattacgcaattttatttgttatcacggcgatttctttttattttaccccttggcttgggcgaatattaatcactgtattattccttagtgcgttattttattgctctgctggttttttctatggtattccatctttgggtattattgcttctgtttatgaaacgaatattaatgaaaccttggaatactacacgactattcctttttggatatttttatttcaagctagttatttcatcctgtttgttgctttaatgaaattaagttttcatgttaaacaacaagcatttaaatggctaaatacggctgttatcagcctattattagttttttcttacaatcaattttctgattggaactatgggtataaattccgtttttatcccgttcttttttattctgaatttgatcgaatgaatgatctgtatttagaacaacgtgattttctaaatcaatccgctaatgcgccttctcaatgggatattcaatcttttatgccaaaatataaaaattatattttgattatcggtgaaagcatgcgaaaagattatatgtcgttatatggttttccattgaaaactacaccatttttagagcgtgtgaaaggcacagtttttgaaaattattattctgcggcaccgaatacgcaaccatctttacaactcaccctatatcgagcagaaaaaggggaaacggtttatacggataatattatttctttagccaaaaaagcgggtgtgaaaacctattggatttctaatcaaggcaaaattggggaatttgatacgatagcatctcgtattggtcaaagtgcagatgaaacgatttttatgaagccgttaggttataactctaaaaaagtttatgacgatgaaatgttgcctgtattagataaagccttaaaagaaaatattagcaattcaaaattaattgtgattcatttaataggctcacatcctgctttttgtgagcgtcttccatacgaggttaaaaattattttattaatcaatcgatgtcttgttatttagaatcgattaaatatacggatcagtttttagaaaaattaaattcacaattggtggcacaaaatgaaccctattcggtgatttacttttctgatcatgggcttgctcattatgaggattctaacggcctatcattgcatccaaataatctttataaacaagattatgaaattcctttcataatgttttcgagtgatagtcaaaaggtagaaaaaataaaaacgccacaatcggcatttaattttgtttatggttttgctgattggatgggaattaaggaaaaacatttacaaggcgtggatttcttccatcctgaaaaacaggaaattaaggtatttgattggaataacgttgtaaatgttaaagagttggctgatgatccagcaaaattaccagaaaccgttcagtaaatgagatcgtgctttatcatttatcggcttgtgctagaatgagcggaatttttttaaaagggaaatagtatgtccaaaaaatcagggctttcgtttttatggttaagtgcggtcgcttttgtgattgatttgctcactaaatacattgtggtacaaaaatttgatttgtatgaaagtgttaatgtgctgcctgttttcaatcttacctatgttcgcaattatggtgcggcatttagtttcttagcggatcatagtggctggcaacaatatttctttattttgttggcattggctatttcaggcatgttggtttattttttagcaaaaaataatgccgaacaaaaaatccaaaattctgcttatgcactgattattggtggtgcattagcgaatatggtggatcgtgcttataacggttttgtcgtggatttctttgatttctactgggatatttaccattatccagtgtttaatatcgccgatatcgccatttgtattggtgcagggttattagtattagatgcgtttaagagcgaaaagaaaaaagtacaagataaacaagtagaaaagtgcggtcagaaatgaagataattttagccaatccacgaggattttgtgccggtgtagatcgtgccattagtattgttgaattagccttagaaattcacggtgcgcctatttatgttcgtcacgaagtggtacataaccgatttgttgtgaacggattgcgtgagcgtggtgcgatctttgtggaagaattaagcgaggtgcctgatggtgcgatcgtgattttttctgcacacggtgtgtctcaagcggttcggcaagaagcaaaagatcgtaatctcaaagtatttgatgcaacctgtcctttggtgactaaagtgcatatgcaggttgcgcgcgcaagtcgaaagggtacaaaagcgattttgattgggcataaagggcatcctgaagttgaaggcacaatggggcagtatagcaatgaagatggcggtattttcctaattgaaaaagtagaagatattgcgcgtttgccaatgcaagaaaatgataatttaacctttatgacgcaaacgacgttgtcgctagatgatacggctgaaactattgctgcattaaaggaaaaatatcccgctattcaaggaccacataaaaacgatatttgttatgcgacaaccaatcgtcaagaagcggtgcgtgaattagcaaaattatcagatttagtgttggttgtaggttctaaaaattcatccaattcaaatcgtttagctgaattggcttctcgaatgggggttaaatcacagcttcttgatgaacctgccgatattcaagctgattggtttaatgatgtaaaaaccattgggattacagctggtgcttctgcgccagaggaattaggtcaatcgattatttctcgtttaaaaaggtttggtgcgaattccatagaagaactgcaaggtttagaaggaaatatgttctttgaggtgccaaaagagctgagaataaaagaagttaattaatactaagggcttgtcgtaaatgataagccctttgttttttcattcaaattaagaatttttgcgatcgagatcgcaaaagtgcggtcagtttcttgagggtttttgcaaggcaggaaaaaataggtgtgttgattgctgatcaacgattcatattataaggaaacctctntgaaattaatgaaaacattattcacttcggttgtattgtgtggtgcgctggttgtttcttcgtcttttgctgaggaaaaagcgacagancaaaccgctcaatctgttgtgacaactcaagctgaagctcaagtagcaccagccgtagtgagcgataaattgaatatcaacacagcaactgccagtgaaattcaaaaatccttaactggcattggtgcgaaaaaagcggaagctattgtgcaatatcgtgaaaaacacggtaattttnctaatgcagaacagcttttagaagtacaaggaattggcaaagcaacactagagaaaaatcgtgatcgtataatcttttaattttttaacctccaatgaatgccctgtttcacagggccttttttattttatactaaaaataattcaacattcatttcagcgattctagcttgagcattttcgggtaatcctttatcacagataatcgtatctagtgaactaagtggatatagtagaaatgttgctactttgccatatttggatgaatcagtaacaaggatattttttgactaaattggataatagcttttngttgacaggaattttttgctcatcaggcgtggttagcccttttaaattccaagatgaagtcgagatgaacgcaatgtcaactgaaatttgatgtagaaattgggcagcaaattctcccacagaggaacgatttgatttattaatgagcccaccagtatgcataatattacattggctattgaccattaaataatgggcaataacaaaatcattagtaattacaagtagatcgtttcgattagcgatttgttttgcgatttcaagtgttgtcgtgccagcatctagatatatagtggaatgttcttgtattaactcaactgcttttttactaatagccgtcttttcagtcgttgctagtaatgatttatcgtcatgtgttggttcactggataaacgttcaagtaattgaaccccccccgaaacagagatgacttttccatcctcttcgagcttttgtatatcacgacgtacggtcatatgcgatacgcctaagatattgactaagttatttatactaataacgctttgtttactaattaagtttaataatgtcttttgccgttcagcaggaatcatctttttctccatacctgatttcaaatcagattatgagctcataacgttttatcactaaaattaacaaaaaataacattttttatcattctgtgatctagatctcagatttaatttattgtatcggctaatatacagataaatttagttaagatctattaggagattaaaaatggaaaatcaaaattattcagtcgcagtaattggtcttggttctatgggtatgggcgcagcggtatcttgcattaatgcaggattaacgacctatggtattgatttaaacccagttgcacttgaaaaactaaaagcggcaggtgcaaaagctgtagcggcaaatggctatgacttcgctcacgaacttgatgctgtagtgattttagtggttaatgcagcccaagctaacgcagtattatttggcgaaaatggtattgctaaaaaattaaaagcaggtacagcggtgatggtttcttctaccatggcggctcaagatgctcaaataatttcacaaaaattaacagaattaggtttgattatgttagatgcacctgtttctggtggtgcagctaaagcattaaaaggtgaaatgactgttatggcatcgggttcaaaacaagcatttgagttgttacaacctgttttagatgccactgcggcaaaagtttataacattggtgaagaaattggtttaggtgcaacggtgaaaatcgtccatcaattattagctggcgtacatattgcagcaggtgcggaagctatggctcttgcctcaaaagcaggtattccacttgatgttatgtatgatgttgtgaccaatgcagctggtaactcttggatgtttgaaaaccggatgaaacacgtagtagaaggtgactatacgccgctttctatggttgatatttttgtgaaagatttaggcttagttaatgacactgcaaaatcacttcatttcccacttcatttggcaagcacagcctattctatgttcactgaggcaagcaatgcgggttatggtaaagaagatgatagtgcagtgattaaaatttttagtggcgttagcttaccgaaaaaaggagcgtagcgatgttaggtgttattgcagatgattttacaggcgcaagcgatatcgccagttttttggttgaaaatggcttaagtacggtgcaaatgaacggtgttccaacacaatcgttaaacagcaaagtagatgccattgtgatcagtctaaaatcacgttccaaccctgtgaatgaagctattgaacagtcattgagggcttatcaatggttaaaggaaaatggttgtacgcaattttattttaaatattgttccacctttgacagcacagcgaaaggcaatatcggtcctgtcacggatgctttactagatgaattaaatgaagatttcaccgttattacaccagccttacctgtaaatggtcgcactatttttaacggctatttattcgtaggtgatgtattgttgagtgaatcaggcatgaaaaaccacccgattacaccaatggtggacgcaaatttaatgcgtttaatggatgcacaagccaaaggtaaaacaggtttggtggcgtatgctgatgtgattaaaggggcttcgcgtgtgcaagagtgctttgcggaattaaaagcacaaggctaccgttatgcggttgttgatgccgtggataattcgcagttggaagtacttgctgaagcagtggcggatttcaaattggtgacaggcggttcaggcttaggagcttatatggctgcacgtttaagtggtggtaaaaaaggcaccaatgcctttacgccaactaaaggtaaaaccgtggtgctttcagggtcttgctcagtaatgaccaataaacaagtggaaaaatatcgtgaaaaagcaccgcactttcaacttgatgttgagcaagccatccataatgaaaattatatagaacaactttatcagtgggtaatagcaaatctcgatagcgaatttgcccctatggtctatgcaacagtgccaccagatgcattaaaagctattcaacatcaatttggggtggatcaagcaagccatgccattgaaaacacgtttgctaaattagccgcgaagttaaaacaatatggcgtaacaaactttattactgctggtggtgaaacctcaagtattgtggtgcaagaacttggttttactgggttccatattggtaaacaaattgccccaggtgtgccttggttaaaagcggtagaagaagatattttccttgcgcttaaatcaggcaatttcggcaaagaagacttttttgaatatgcacaaggaatgttcctatgacggatttagcacaaaaagaattaatggtgcagctcggacgttctttttatgagcgaggttacaccgtgggcggtgcaggtaatttatcagttcgcttagatgacaatcgtgtgttagtgacccctacaggttcttcactcggtcggttaagtgtagaacgtttatctgtattggatatggaaggtaatcttttagggggcgataaaccatcgaaagaagcagtatttcatttggctatgtacaagaaaaatcctgagtgcaaagccattgtgcatttacatagtacctatttgaccgcactttcttgcttagataatttggatcctaataatgctatagagccatttacaccgtattacgtaatgcgcgtgggaaaaatgcaagttattccctactatagaccgggttcaccaaagattgcagaagaattaagtaacagagctttaacaggcaaagccttcttactcgctaatcatggtgttgttgtcactggctcagacttgcttgatgcggcagataatacagaagagttagaagaaaccgcaaaattattcttcactttgcaaggacaaaaaatccgctatctcactgataccgaagtgaaagatttagaaaatagaggaaaataattatgcctaaatttgcagcaaacttaacaatgatgtttaacgaagtgccatttttagatcgctttgaagcggcggctaaagcaggctttaaatatgtcgaattcttatggccttatgattaccctgcacaagaactcaaagcaattttagataagcatggcctaaaagttgtgttatttaataccccagctggtgatgtaaacaaaggtgaatggggggggtcggcaatccctggccgagaagctgatagccatagagatattgatttggctcttgaatatgcacttgcattaggttgtccaaatgtacatatcatgtcagcagttgtgccagaaggtgcaagccgtgaagaatataaacaaacctttatcaaaaacgtacgctatgcatctgataaatataaaccatatggaatcaaaattcagcttgaagctttaagccctgaagtgaaacctaattatttactcaaaagccaatttgatacgcttgaagtggtggaattggttgatcgtgataatgtatttgttcaactcgactattttcatgcacaaaatgtagatggcaatcttgcacgtttaaccgataaattaaatggcaaatttgctcacgttcaaattgcttctgtaccagaccgtcatgaacccgacgaaggtgaaattaactaccaatatatcttcgataaactagatgaaatcggttatacaggctatgttggctgtgaatacaaaccacgtggcgaaaccgtaacgggattggattggtttcagaagtataaataaatattcttaaatttaactgcggttttaaaaacacatattatctaaggnggataaaatgaaagttgtaattactggtggacaagggttcttaggacaacgtttagccaaaacgctattagcccagaataatgttcatattgatgatttaattttaattgatgttgttaagcctattgcgccaaataatgatcctcgtgttcgatgttatgaaatgaatttacgttatccaacaggattagatgaattaattactgaagaaacggatgctatttttcatttagcagctatcgtaagtagtcatgcggaacaagatcctgatttaggttatgaaactaatttcttagcaacacgaaatatccttgaaatttgtcgcaaaaataatcctaaagttcggtttattttctctagttctttagccatatttggtggagaactacctgaaactattttagacagtacagcattcacaccgcaatctacctatggtacacaaaaagcaatgtgtgaattgctgattaatgattactcacgaaaaggctttgtagatggtattgttgttcgtttaccaaccatttgtattcgaccaggcaaaccaaacaaagctgcatcctcatttgttagcagtattatgcgtgaacctctacatggggaggatgccgtgtgtcctgtatcggaagaattacgtttatggttatctagcccaaatacagtagttgcaaactttattcatgctttacaacttccatcacttccattgcgtagttggcatactattaatcttccagggtttagtgttaccgtaaaacaaatgttatctgatctcactcaagtaaaaggtgaagcaattttagaacatattaaatttgagttcgatgaaagcattaacaatatcgttgctagttggccttcaagaattgataacacccaggcattagctcttggtttcaaagtggatagcaatttccaaaatgttatccaacagtttattgaatatgatatgtaggaggcactatgtttggcttaccgattccaattattggattattaatcgctgtatttgttctcgtttttctcgtattaagaacgcgagttcatgctttcatcgcaatgctaattgcagcttcaattgcaggtttagtaggtggtatgtcagctgatgaaaccttaaattccatcacaaaaggatttggtggcacactaggtagtattgggattgttatcggacttggtgtaatgatgggtagcgtcttagaagtttctggtgcggcagaaaaaatggcatatagttttatcaaaatgctaggtcagaaaaaagaagaatgggcattagctattacaggttacgtagtgagtattccaattttcgtagattctgcatttgttatcctttatccagtagcaaaagctctcgcaaaaaatggtaaacgctcattattaactctaggcgttgctttggctggtggcttggctgtgacacaccacaccgttccaccaacaccaggtccattgggagtagctgggttatttggtgtagatattggtgcaatgttactcactggaatgtgtatggctttcttgcctgttgtaggaatagttctgtatgctaaatggttagataaaaaataccctaactttaatcaagaagtgttcacggaagaagaattaaaacaaaaatatgatagttatattgaaagtcgtgagaaaaaagaacttcctagtttagggctttctttactaccaattgtattaccgatagtattaatctttattaaagcagttgtacatttattcgttaaagatgtacctgaagcattgacaagtataccttatcaaatcgtttcattccttggtcaccctgttattgttttagcattaagcgtattaatttctgtttacacattattaccaaaagccgataaaaatacgactgcacttcatcttgaagaaggtgttaaaacagctggtattatcttattagtaacaggtgcgggtggtgcattaggtgcggtattacgcgatagtggtgctggaaaacaattagcagaacagatcgcaaacttacctatttcaccaattttaattccatttatcgtatcgaccttagtgcgttttattcaaggttcaggtacggttgcaatgattacagctgcttcaatttcatccccaatccttgcacaaatacctggtgtcaatatgctattagccgctcaagctgctaccatgggatcgcttttctttggctatttcaatgatagtttattctgggtggttaaccgtatgatgggaattaatgatgtgaaaaaacaaatggtcgtttggtctgtaccaaccacgattgcttgggggattggtggtatttcagtaattctggctaacttgatttttggcaacgatggctctgtatttgatctgcttttccctgttgtcgtgttagccagcattttattctatatcaaacttcagaataaaaatctttaattacggttaaaatttaatagtgatacgttgtacagatataaatgagataacaccatttagcagttttatctctaaaataccaaatcattgcggtacacatatggatgcgtcacgccactttgtaaaagatggtttaagtatcaatgaactgccaattgggtatttttgccataaggatgttgtattacttgaagttccaaaaggagaagcggaagggattacgaaagaagatttagagccttatgcggctattttagcgcaagtatcgtttgctttcttgtgcacagggtttgagaaatacagaactgagaatccgttaatttatcaaaatgaaggaccatatattgcgactagtgcgggaaaatatttatccgataactatcctaatttaaaaggagtaggtatttggtttccttgcacttggttcgccgtcttctcgtgtacctgatacagaaaatccgaaaaattgccaccaagcgatcttaggttatcaatgcaccattacgcattgtcgggctagattcaagccaacttgtattgctgaaattgaataaatgatggagtgctagggttatctctagcactctttttatatctagataggagtgaagattatgtaaaatatcaacctttatcttggtgaacttgtgggaacagcattttttatggtgttaggacttggcgtttgtgccaatatttccttaaaaaaatcaggaatgtatgggaacggtggtttacttaccgcttgtggtttggattatcaatggtgtccattgctgttatttttggaccactcaccggcgctcatgtaaatcctgctgttactatcgatttttgggaggtaggtaaatttccaacagaacttgtgttagtctatattattgctcaatgtatcggtgcgtttattgttgctctgattgtatggctattatttaaagatcatttagatgaagaagacaatcaaaattgtcaattaggttcttttgccactattgcaacaaactctaataacttacgcaatttactttctgaaattgtcaccacattttcattgttatttattttattcacactaaatcatcaacaacctactaatggtgttgcaatgttctttgtttttacgggagtagctggtggtgttatgtcctttggtggattaacgagttatgcaatcaacccagcacgtgattttatgctgcgtcttattcacgctatcatgccaattaaaaataaaggtacttccaatttcgattacgcttgggttcctgtcttgaggcctgtaattggtgcaatattagctgcttggttatacaaagcattgttttagttttaatgtgggggaagataaggatgtagttaaatgtgttatagttttggggctgacgtagattagccctaaataccactccattttcgcaatgttttaagctgttcttttggcactccaaagttaaaccgaaattcacattccttcaagaataaaggaaagttttttcggtcgattccattatattttcggaggattctcttcgcctgactccagaaattttctattccatttatgtggttttgtttcaccgcaaatagttcggaatgattgattcgttcgtggtgaaatttgctcgcatcaagggcatcatagcttcgataagtatcggtataaacccagctgtcaggcttgatttttctcacaataacaggcattaatgtctctgttttgtattttctaccactactgtaaatatttttccttgtcgctttaacaaaccgaatacagcaacttttcctgctgcacctcgacctcgttttcctttatgatgaccgccaaaatagctttcattaagctcaatttgatcatcaacaacctcatcggcttcaagggctaaatgatagctaatgacttcacgaatttttctataaaaaaatcgctgaattggcttagatatcgagtaaatcagccgctgctcgggctgtaacttctaatacaaaaaattcaagtagcttattttgtatagatttctttaatttacaatgagttatcttcatttttatagactagtgcacttgctaatctacgtcagcccctttattttttcagaaaatgtagaaagtttatttctttttaaaaagccgttggcaatcttagtaaattttaatacactagaaagcctagtcggggtgcaatacgctgagatcatacccgtgaacctgaaacagttaatactgacgtaggaaactaggaatataaccttatctccttttcgtcattattgctgccttttaatcataaataaggatgtaataatgaaacttcttaaattaaccttaatttctaccgcacttttttccaccgcagcattagctcaagcacagcaaagtgtaaacgtatatagctacgactctttcacttctgaatggggggctgggccaaaagtaaaacaagattttgaaaaagcccatccacaatgtgcgattaattttacgccttttgaaagcgttggtgtgttgctcaaccgtgttcgtttggaaggaaagaaaacaaaagcggatattgtgctaggtttagataacttttttttggaacaagctgaaaaaacaggtatttttgcgccaaataacgtggatttaactcagctggatttaccaacaaaatgggcgaataaaaccttcttaccttttgatttcggtaattatgcttttgtgtacgataaaactaaattacaaaacccgccgaaaagtttgaaagaattagttgaacgtcaagatcttagtgtgatttatcaagatcctcgcaccagcagtgtgggtcgtggtttattggtttggatgaatgctgtttaccctgctgataaaattcaatccgcttggaaagagttagataagcatacagtgacagtgggtaaaggctggtcagatacttacggtgcatttttgaaaggcgaagcggatttagtattaagttacagcacatcgccactttatcatcaactttttgagaaaaaagataattatgcggcgacagattttgcggaaggtcatattactcaagtagaattagcggcgcgagttgcaaaccatccaaatcaatgtgcggatgattttatggcatttttaatttcgcctacagcacaaaaacatattgtgaccgcgaacattatgttgccagttattcaaggcgaaattgaaccgcactttgatgcacttaaagttcaacaaaaaactcaaacgtcaattaatccaatggtgaatactgagcagttaaaaaattggatcagcacttggcaaactacattaacaaaataatttgatgttttcgttatttcatcatccacaacttcgccctcgtcattatgcgggcggggttgttgttattagtttcattattcttttttatggtggtgccttaagttcgatctttgcattgggcggtgaattgcaatggcgagcttggtttactgatgattatctacagcatttgattcttttcagttttgggcaagccttactgtctaccgttttatctattttctttggtttacttctcgctagggcattattttataagccatttttgggaaaaaagtggttgttaaaattaatgtcgctaacttttgtcttacctgctttagtggtaatttttggtttgatcggcatttatggttcaagtggttggttagcttggcttgctaacctttttggaatgtcgtggcagggacatatttacggactttcgggaattttaattgcccacctttttttcaatattccactggcagcacagcttttcttacaaagtttgcaaagtatcccttatcagcaacgtcagcttgcagcccagcttaatttgcaaggttggcaatttgttaaattggtggagtggccggtttttcgtcagcaatgtttgcctacattcagcttaatttttatgctgtgctttaccagttttactgttgttcttacattaggtggtgggcctcaatatacaacattagaaacagcaatctaccaagcgattttatttgaatttgatctgccgaaagcggcactttttgctatgttgcaatttgtattttgcttgattttatttagtttgacatcgcgtttttcgctttctaatcaaaatggcttgagcaatagtaatatttggtttgagaaacctaaaagtgcggtcaaaattttccatattttggttttacttgtttttgtctttttccttttttcgccagtattgaatattcttattagcgcattgagttcatcaaatttactcacagtttggcataattcccagctctggcgtgccttaggctattcactttctatcgcgcccttgtccgcattacttgcattaacgatggcaattgccttattgcttttatcacgccgtttagaatggttgcattatcaaaaaatctcacaatttattattaatgctggaatggtaattttagccatcccgattttagtgcttgcgatggggttgtttttattattacaagatcgtgatttttccaatattgatttgtttatcatcgttgtattttgtaatgccttaagtgcaatgccttttgttttacgtattttaagcgcaccttttcataacaatatgcgttattacgaaaatttgtgtaatagtctgggaattgtgggttggcaacgtttttatctgattgaatggaaaactttgcgcgcaccgctgcgttatgcttttgctttaggtttagcgttatctctcggcgattttacggcgattgcgttatttggcaatcaagagtttacttctctaccgcatttgttatatcagcagctagggaattatcgtaatcaagatgcagctgtaaccgcagggattttattattgctttgtggcatattgtttgcctttattcacacatatagggatgccgatgatttatctaaataatgtgattttgaatgataaaaccttaccgatgtgctttaatttgagcgtaaatgctggagaacgtgttgcaattattggcgagagtggcgcggggaaaagtactttattgaatttaattgctgggtttgaatttcctgctcaaggagaaatttggttaaacgataaaaatcatacgcgtagtgcgccttacgagcgtcctgtttctatgctatttcaagaaaataacctatttccccatttgactgtacaacaaaatcttgccttaggaataaaaccctctttaaaattaaccgcacttgagcaggaaaaaattgaacaggtcgcttgctccgtaggattaggcgattatttagagcgtttaccgaattctctttcgggggggcaaaaacaacgagtggcattggcgcgttgtttgttgcgagataagccaattttgttattagatgagcctttttctgcattagatcagaaacttcgggtagaaatgctggctttaatcgctaaactttgtgacgagaaagatttaacattgctacttgttacccaccaaccatcggaattaatcggttcgatagatcaagtgttagtggtggaaaatggtcagataagtcaattacaaaaaggggtgtaaaattagtttcattcataacgttgaattgattgtttctaccatatacactaattcatcaattaagaaagtataaaaagcgtggtgtttttaaccgcactttcaaaggaaaaacatgttagcggaaaaattacaaattaactctattacacctcatccaagtgtagaatattggtctgtttgcaaagttgaggcgttatttgaaacgccatttttggaattagtttaccgagcaacgcaagttcatcgtaagcattttaatcctcgcgcgattcagttatccacgttaatgtctatcaaaacggggggatgcccagaagattgtagttattgccctcaatcagcccgttatcatactggcgtacaaaatcagcagttattagatgttgatgagatcgtcgctaaagcaaaaattgcgaaagcacgtggtgcagggcgtttctgtatgggggctgcttggcgaggccctaagccaaaagatattgagaaagtcacagaaattattaaagccgtgaaatcacttggtttagaaacttgcggtacctttggtttattgcaagacggtatggcggaagatttaaaagaagctggattagattattacaatcataatcttgataccgcaccagaaattatgcagaagtgattggtactcgccgttttgatgatcgccttagcaccttaggaaaagtgcgcaaagctggattaaaagtgtgttgtggtggcattgtagggatgaatgaaactcgcaaagaacgggctggattaatcgcgagccttgcaaatcttgatccgcaacctgagtcagtgccgattaatcaactcgttaaggttgaaggtacgccgttagccgatgcggaagaattagattggacggagtttgtgcgaacgattgctgttgcacgtattactatgccaaaaagttatgttcgcctttctgcaggtcgcagtggtatgactgaagaaatgcaagcgatgtgttttatggcgggtgcaaattctattttctatggcgataaattacttgttacagataatccagaagaagatggcgatcagttattgatggcaaaattagatttagagccagaaactgcagaaaataaaaagttgtagtttgcgttagaaagctgagaaattaagtataaatctattcctttctttatttcatatctcacaataattttcaatagccaataataaagctccttgaatatcaaggagctagtttagtttaatcttaaagaatttctttcgcttttgctaccacgttttcaacagtgaaaccaaagagtttgaataattgatctgctggtgcggattcgccaaagctattcataccgataacacgaccattgaatccaacgtatttataccagaagtcagcaatacccgcttcaatcgcaacacgtttggttaccgctgcaggtaatacactttcacggtacgctgcatcttgtttatcgaaacggttagtacttggcatagaaacaacgcgtacttttttaccttcagcacttaatgcttcggctgcttgcactgctaattccacttcagaacctgtcgcaatgaagattaactcaggtgtgccatcacagtcttttaacacataagcaccacgtttaaccgcatctaattgtgcagaagtgcggtccatttgggctaagttttgacgggtaaagatcaacgcacttgggccatcttgacgttcaaccgcttgttgccatgcgatggctgattcaacttggtcacatggacgccatgtttcaaggtttggaattaagcgtagtgaagccgtttgttctactggttggtgtgtaggcccatcttcgcctaaaccaatggaatcgtgggtataaacgaataatgtgcgttgtttcattaatgctgccatacgcaccgcattgtgagcatattcgtagaacattaagaaggttgcgccgtaaggaatgaaaccgccgtgtaaagcaataccgttcataatggcagacataccaaattcacgaacgccgtagttaatgtagttaccacctacgttttcgtgggcacgaattggtttagaaccactccataacgttaagttagagcttgctaagtctgcagagccacctaagaattcaggtaatacgtgcgcataagcttcgatagcattttgtgatgctttacggcttgcaatactcgctggatttgcttgtaatttttcgatgaacgctttagattctgccgcccagtttgttggtaattcgccagaaacacgacgtttaaattctgctgctaattcaggataggcttttgcataagcggcaaatttttcttcccaagatttttctgctgcagcacctttctcttttgccgaccattcagcatagtattcagctggaatttcaaatggcgcatattcccaaccaagtgctttacgggttaaatcgatttcttcatcgcctaatggtgcgccatgggaatcatgagaacctgatttatttggtgaaccaaagccgatgatggttttacaaataattaacgttggttttcctttttctgcttgagcaagaatggtagcagcacgaatttgctctgcatcgtgaccatctacattacggattacttgccagccataagcttcaaaacgctcggcagtgtcatcactgaaccagccatcaacatgaccatcaatggaaatattgttgtcatcgtagaatgcgattaatttacccagacctaaggttcctgctaaagagcaagcctcgtgagaaatcccttccattaaacaaccatcgcctaagaacacataagtgtggtgatcgacaatttcatggccttcacggttaaattgtccagctaaggttttctcagcaattgccatacccaccgcattagtgataccttgacctaacgggccagtcgtggtttcaacaccaggggcataaccatattctgggtgacctggggttttagaatgtaattgacggaattgttttaaatcttcgatagaaagatcatagccagttaaatgtaaaagactataaatcaacatagaaccatggccgttagaaagtacaaaacgatctcgatcagcccatttaggattggttggattgtgttttaaaaagtcgcgccataatacttcagcaatatccgccatccccattggtgcaccagggtgaccagatttcgctttttgtacagaatccattgctaagacacgaattgcattggctaattgtctacgagttgccattttgttctcctgtgaatattttgttattttcctaatcttgaccgaaagtgagtgcaaatacttgtaacaatatcttgcaaggttactatgtgaaaattaggtggcagctattttatactattctgcctttatatccaaaattgccctattttctgttttaattgctctgctatctctcgacctgatttaccaactaatgctctacccgcaataaacgctttcaaattttttgtatttttaaacaaatggagatcgtcaggagtaatacctcctgtaatagataattcgatacctaatgaatctaatttttctatattttcaatatcttgatttgaccaacttaaaccagataattcggcatctcttgaacggtgatagatggcttgtttgataccaagttgaagccagttttttacttcatcaaaattccaattaccataaagttcaatttgaatttcctttggtacaccaagattaggttgaattttgttaaattcttctgctactttttggcaagctgcttttgttgctggatgagctgctgctgatacggtaagccaatctgccccagcttcaaatgccatttttgctaaagtagcacctgcatctgttgttttaagatcgcaaacaagaatttgattaggatataacgcacgtaatattcgcactgcacgcattccctctgaacatgcaagaattgttccgacttcaataatatctatattatgttcaatctgttttacatcaactaatgcagtctctaaatattgggcatcaagagcgatttgtaataaaggttttcccatcgtttttccttaaataatatgaggaaggcagtataattctgtctttaattcattgaccataataggcattttgaccatgtttgcgtagataatgtttatccaatagatctttttgcataggagatagataaggattaagttgctgagaaaataagttcatataagcaacttcttctaaaacaacggcattatgtaccgcattatttgcatcttttccccaagcaaatgggccatgactatgcactaataccgccggaatattatcaggttcaattcctctcgaaagaaaagtttcgacaatcacttttccagtttctaattcgtaattaccttttatttcctttgttgtcatttgacgggtacaaggaatcgtaccgtaaaaataatcgccatgtgtagttcccacctcaataatatctaagccagcctgagcccaaattgtggcatgtcgagaatgtgtatgaacaataccaccaatatgaggaaattgtcgataaagctcaagatgagttggtgtgtcagaagaaggttttttattgccttcaacaatatttcctgtaaataaatctacgacaaccatatcattttctgtcattacatcataatctacaccagatggtttaatgacgactaaatttttttcacgatcaattgctgaaacattaccccaagtaaaagtcactaaatgatgtttgggtaatgctaaattggcttcaaaaacctctttttttaattgtgctaacataataatcctgccttttccatttgttgaactatccacttacgagcttgaataatttctaataagggttcttcatttttttctgtccacatttcaattaagaatgcacctctgtaattcaatttttttaataggctaaaaaaatgaacaaaatcaacacatccttgaccaaaaggtacatctctaaattgtcctttacttgtttcagtgacggggtaagtatcttttaaatgaatagctgatattttatctatgcctaatgtaagttcttcttcaatattattattccaagcacttaaatttcctatgtctgggtaaacggtaaaccacggagaattaatgatggtatcccattttttccaacgagaaatagaactcataaaaggcgtatccataatttcgaccgcaagagtaacttgagctgatgcagcaagagttacagcgaattcaataccctcctgaaaatatttgattgtttcttcatcttgtttttcgtaatacacatcataacctgctaactgtatggttctaatgcctaaattcaccgaaagatcaatggctttttccataatttcaaaggatttttgacgaatttttttgtctttactaccaaaagggaagcgacgatgagccgacaagcacatagaggggatagttattccactttgaataatagattgatgtagagctattctttctgattttgtccagtttaaacgagataatctgtcattgctttcatcaatagacatttcaataaattcaaagccacatgctttagcgagagataaacgctcttgccaagtaatatttttcggtaatgctttctcataaataccgattttatgttttttcataacttttccttttttagtctaaattttttaatgcttcaataaactttaaatagcgatgatatttatgctgatacttactatattgatttttatcaggtaaaaatattttcctatcaatatttaatatttgagaaatttcaaccgcactttcggcttgcatcgccatcaatgctgcacctaagcaaccagtttcttcaatattagggatttctagtctcataccacttatatccgcaagcatttgcatccaaacttctgattttgctggtccaccagttacgcgaagcgkgcttgcattaggaaaacgtacttgcattctttctaaatgagacattaggctaaatatcacaccttcataaattgcttggagtaaatgtatttgggtatgatgagattgaattccataaaaccctgcttgcatacctaacttagcattagagccatataaaaaaggtgcaaataagactgagctacttgcgggtttaagttttgcaatttcgtgattaatgtcatcatagttaggcaaattaaattgatttacaaaccactctaaattacctgctgatgttggacttgcttcatgaataatgaatttatttttttctggatatttgccatacacaaaaggaattgtttggttatcatcaatataatgggtcaccccactaacaacagaccacgtccctaatacaacattaagatgttgatcatccttcaaatcagcgcataatgcagtggataccacatcaaataatcctccaacaacaggtattccttctaccaaaccagattgctctgctgctctggaggttacatatcctgcaattttatttgatttaatgattggaggtaatttatctatgcattctgttataccgaataacttagctaactgaatgtcatattttccttctcgcatattgtaaaaattagactcagaaatatttgtttcttcacaatataatttttcagttaaacaaaatcgaaggtaatcgtgagacattaaaatcgtatgaatttgctcatatcgactgggttcattttcttttatccagcgtaaaatcgagacaggatgtcccatccaaagagtttggagtgtgataggataaaatttttgtagtatgttttctttttgccaacattgcacaatttcgtatgcccgttggtcagatgataagattgctcgccctaatggtttattatctttatctaaaaaaaacgcacctttaccttgtgcagaaatgccaatagcttttatttgttgaggcaaaatactactttgtcttatagttttctgaataacttgcgcgcaaagattccataattcatccatatcccgttcagcataaccgggtttttcactaataataggaatatttctgcgtgcaatactttgtagtgtaccattttgatcaaaaatcgctgcttttataaacgtaccaccacaatcaataccaagatagtaatgcatatattctccttagttttttatgggctggatttttattatgtaaaatccagcctattgactattccgataatgcatctactttcttcaataaatcatcgccatgtttttcaataaagcttttgcgaactttttcttcaatcaaggttttaaagggctctgtattgattttttcaatgacttcaactccttgtttacgtaatttactaataatattttgttcgttttttacattaagatctcgttggaattgtccagcttctttagctgcttctataatagctgtttgtaaagctggtaaaagtgaatcaaattttgctttattcatcacaacaatgagaggtgtatagccatgattagtcaaacttaaatatttttgtacttcatagagttttgaagaccaaaaaattccaatcggatgctcttgcgcatccacagctcgagtttctaatgccgtgtaaagttctgctaatggcattggaacagggttacttcctagtaatttgaatgcctcaatgtacatcggattttgatttgtccgtacttttaaccctttaatatgttcaggttttgttactgtttgtttagaatttgaaaatgcgcggaaacctacatcccaaaatgctaagccttttaatccttgtttctctaagtcttttaataaattctgtcccacctcgccatctaatactttataaacgtgttcacgatctttaaaaataaaaggaatatcaatgacatttaatttaggttctaatcctgtaaaatttggtgatccagacatttcaagatcaattgttcctcctcttacactactaatcattgtttgtgcattacctaaagtactatcgggaaataattttagtttgatttcacctttcgtttttttcatcaaaagatcattaaattttttagccgcactatgttggctatctgagcgtggcgcttcatagccaaaacgtagtgatatttcagctaatgctggagaagtaactaacgtaaaaccagcgattagcatgctaagctttttgaagttgaaaagtttcataaaagtctccttgtgttaagaaagtctgttttactggatccattgtagtggcattaaaattagttctggaataaaaataaaggtaagtaataacataatcatcatccctaaatagggcataatacctttcgcagcctgatcaaaaggaagctttgatactccagtgataacgttcaacacattgcccacgggcggtgtaattaagccaattgaggtatttaagataaacaatacgccgaaataaactggatcaattccagcttcttccacaagtggcattaaaacgggggttaaaattaagactgttggtgttaaatccattaccattcctatcacaaatacagcaagcataatgaccaaaagtaaaattgttggattttcaattaaaggttcaagcaatattgtcagcattgtgggaagttcagcaacagtaattaagtagccagttacattagctgaggcaaccaaaaacataacaactgcggtggtttttgctgcagctaacaatacttttggcaaatgttttaagggtaattcatgatatataaagagagaaacaattaatgcataaaatgttgcaactacaccagcttcagtaggtgtaaatatacctgaacgaaatcctcctataatgattactggtagcattaatgcccaaacactatttttaaaagaaaaacaaagatcttgtttcgttgcttttgaaaatgtcattaaattaaggcgtttagcttgccaccgccataaaatagctaggcaacatcccataatcacaccagggaaaatacctgctaaaaataatttagtgatagatacaccactggcaacaccaaagacaataaaaggaattgatggaggaattataggagcaatgataccagcagtgccgattaaaccagcagaacgatgtattggatatcctgtggttttcatcattggtagtaacatagcagctacagcagcagtatcagcaacagccgaaccagataagcttgccataatcattgcacttaaaatagcaacaaatcccagccctcctcgtttatgacctacaagtttcataggtaaatcaataatacgtttagaaagtcctccctcattcattatttcaccagcaaggataaaaaagggaatagccattagagaaaaactatctgcgccactgacaagttgttgtgcaagtatttgtgcattaaaaaagtctagatggagcattagtgctattccacaaattagcaaggcaaaggcaacaggtacaccaagaataatggtaccaagcaagacggaaagaaaaataatcactgtcattttacttctcctctgaatataaagaatattgtgcttatcaagcgagtaatcagtattgcgctaactaaaatgcctgcgattacacttgcaaagtaagttagtccctgaggtaatccagaaataggagcgaaattattaagattaagctgaaattgaatccaactgccctcaatgatgagatagcaacaaatcagcatcatcatatctgtaataaatttaagtatagcttgaccaaatggaggcagcttgtttaccaaaacagtgacactaacgtgttgattctcattgaaagctaacaccgcacctaaaaatgccagccaaataaagagataacgagaaatttcttcagttatactaataccactattaaatccatagcgtaaaacgacattcaaaaacactagaatggacatcaaggctaaaatagaaatacaaagtatctctagtgctttgttaataaagtgggcgagagatctcatcattacacctccaattgattatcacaaatgtgattcgttttatattatggcgttttactggaaacatattgctgttataacgtctttaattttgcccaaactcgttcatccactggaataccattagtttggttatccgaaagaatagtggtaaattcatgaccaggtaggcgaacagcttgagttggatcagatcgttctgctgtttttacataatccataatgcggtttaatttttcatctttgcttttaccatcaattaagcgatctacttcaatggcgataaacacttgagaaacacagtattcatcgtttttatcttcagttacagcaactgtcgattcaccattcgatagtaaggttgcaatcatatccagcacgatagataaaccagaacctttccaaaatcccattggcagcaaacgacggtttttttctacaatagagggatcacgagttaaatttccttcatcatcaaaacctgcatcaacaaaggtttgacgaccagctaaacgatggacttctaacattccataggaatacattgagcaagacatatccaccatagtgattggtgtggtaggaactgcaataattaatggattcgtccctatacggcattctttagctccccaagggggcattaccgctaatgcatttgtccaacagatcccgatataacctttttcagccgcttgccaaccgtaagatcctcctcgcatccagtgattagcattacgaagtgctattacaccgacaccatgttgtgaagctaactctattgctctatccatcatttttttggcagtcaaattgcctattgcttgatgtgcatcccactgttctatagaacctaaacttaatacttttgtagggattgcattgggtacaatatctccctgttcaagttgttgaataaaacgaggaaaacgatttataccgtgtgaataagcacccgcttgtgttgtgtctgtaaatgcagtagcgcattcttctgctagttcctcagtaagctgacgatctaataaaacacgcttaaactcattttttaattcatcataagaaactctcattttttcctctcttaattttatatagtaaaattacgtttcataatttacaaaaataagaaagctcagtcaataaatgtaaaataaataaattatttataaatcaatatgttaaaataattttactgattttgkgatctagatcctattttcttgtgataatatttcatattgtgaaatgaatattgaggtgaaaatggaaaaagaaaaaagcttaggtaatcaagctctaatcagaggattacgattattagatattcttagcaattatcctaacggttgcccacttgctaaattagcagaacttgctaatttaaataaaagtaccgcacatcggttgttacaaggrttacaaaatgaaggttatgtcaaaccagcaaatgctgctggtagttatcgattaaccataaaatgtttaagtattggtcaaaaagtgttgtcgtctatgaatattattcacgtggcttcaccttatttagaacaacttaatctgaaattaggcgaaactatcaatttctcaaaaagggaagatgatcatgctattatgatctataaattagagccgactaatggaatgttaaaaacacgagcttatattggccaatacttgaaattatattgctctgcaatgggaaaaattttcttagcatatgaaaaaaaagtagattacctttctcattattggcaatcgcatcaaagggaaattaagaaattaactcgttatacgattacagaattagatgatataaaacttgancttgaaacaatccgtcaaacagcttatgcgatggatagagaagaaaatgaactaggcgtaacctgtattgcttgcccaatttttgattcatttggtcaagtggaatacgctatctcagtttcaatgtctatttatagactcaataaatttggtacagatgcttttttacaagaaatcaggaagacggctgaacagatttctttagaattgggatatgaaaatatctagcataaatatcatataatancagataaaatattctaaaattaattgcactttctatgttattaaaagtaatcatacataataaaatcttcttaattatttgttaccattagttagagtaattcaattttttagcaacttacaggatttttatgcaaattcaatgtttcgaaagtattacacaaaaatacccacaatttcctaccgcacttttggctaatgaggaacctatacagaacggagagccttttatcttatacggcacaaagttggacataactaagctagaaaaatttcaacaaaagtgcggtcaaaattttcagatttttgatgtttggatggtagcgaaaaatattatcgtcttattgaaaggtcagtggttttctgatttcattaaatttactcacgatgttgaagtggatattgctaaattagatttcagccctaaattgtctcaagcagggttgttggtgatggatatggattctaccgctattcaaattgagtgtattgatgaaattgcgaaattagcgggtgttggcgaacttgtttctgcgattacggaaagtgcaatgaggggggaattagatttcgagcaaagtttgcgttgtcgagtgggtacattaaaaggtgcgccagaaagtatcttacagcaagttagagagaatttaccgctaatgtctggattagttgaaacgatccaaaccttacaaaaatatggctggaaaactgcaattgcttcaggcggatttacttattttgcggattatttgaaagccttattacagcttgattttgcggcatcaaatcaatttgatattgaagatggaaaactcactggcttagttaaaggcgatgtggttgatgcccaatacaaagctaaaacattacaacatttgttagaggaatacggtattgattcacgacattctattgctattggcgatggggcaaatgacttggcaatgatgaatgtggcagggctaggtgttgcgttccacgctaaacctaaagtgcaaccacaagcgcaaattgtggtaaacttcgccgacttaaccgcacttttatgccttttaagtgctaatgatcgaatttaataaaacgggagaagactatgccatcttttgatattgtttctgaaattactttacacgaagtccgtaatgcagtggaaaatgccaaccgtgtgcttagcacgcgttatgattttcgtggtgtcgaagcggtaattgaattaaatgaaaaaaatgaaacgattaaaattactacagaatctgatttccaacttgaacaattaattgagattttaattggatcttgcattaaacgtggtattgagcacagttctttagatattccagcagaaagcgaacaccacggtaaactttacagtaaagaaatcaaacttaaacagggtattgaaacagagatggcgaagaaaattactaaattagtaaaagattctaaaatcaaagttcaaactcaaattcagggcgaacaagtgcgtgtgacaggtaagtcacgcgatgatttacaggcagtcattcaacttgttaaaagtgctgaattaggccaaccattccaatttaataattttagagattagttttcaaataagggcgaaatgttgtcatagttttttgataaaacttgacgaacaccgctttcaagcgtaacattcgcccgawtttttaacgagaaggacacacactttggacagtcatagtcgataccgaatatcgctctagacgctcgccttttattatcggcgcgcgttcgccggtaaatttaccgttgtttcggcatctcttaacgaaaactttgcgatttttcaccgsactttcgtttcttctttaatttgttcactgttagctgttcataatcctataaggagtatgaaatgatcaacgcgtttgctatcaatgattcccgcttggttcgcattgacgaagaccaaactgatctcaatactgccatttggcttgatttacttgagccgacaggcgaagaacgtgaaatgctacaagaaggcttaggccagagcctagcatcttttctagaactggaagatatcgaggcttccgcccgtttctttgaagacgaagatggtttacaccttcactcatttttttattgcgaagatgaagacaattatgctgatttagcgagcgtcgcttttactattcgtgatggtcgtttatttacgttgcgtgatcgcgagctaccagcattccgtttatatcgtatgcgttcacgtagccagcgtttgttagaatgcaattcctatgaagttttactggatttatttgaaacgaaaattgagcaattagcggacgtgattgaaaatatctatgcagatttggaagagttaagtcgtgttattttaaacggaaaacaagatgaagcctttgatgaagcattaaatacactcacggaacaagaagatacgagctcaaaagttcgtttgtgcttgatggatactcaacgtgcattaggtttcttggttcgcaaaactcgcttaccaactaatcagttagaacaagcacgagaaatcttacgagatattgaatctttgcaaccgcataatgaatcattattccaaaaagtaaactttttaatgcaagctgcaatgggttacatcaatattgaacagaacaaaattatgaaattcttctcagttgtttctgtgatgttccttcctgcaacattagttgcatccacttatggtatgaactttgattttatgcctgagttacattttaaatatggctatccaatggcaattggattaatgatcgcagccgcattgacaccatatatttattttagaagaaaaggatggctatgatggaattatcccaaaccgcattatttatcggatcaattattaatcyttacgcacttgtattaatcttacgagcttggttgcagtttgctcgtgtggattattacaaccctgtttcaacatttgcagtcaaaatgactgatccagtattaaaacctctgcgtaaaattgcgcctactgtgaaaaatatcgatacttctgctttactgctaatatttattatcggtatgttaaaaggtattatttattttggcttatcagtaaatgtactcttagtattaggcgtattaactgtattgaaaagcattggtttagctattttctatgtgctttttattggggctgttttaagttggtttaatcgaggtaataattctataagttatgccttttatcaactctccgaaccacttttaaaaccaatccgtcgattattacctacattaggaatgattgatttttctccgatggtcgttatgtttatcttattgtttttaaacaattttatgcttgatcttctagggggactttggattatcgctggttagatattcatattccttatttgaatattgctttataaaaatattgaagatttagttggtaagaatagtattttctattcttacctttttatttcgtttttagaggtttttgatttttataantcttataaaagatataaaantcttttataaaaataaggggaagtttatttacattgacatttaaatagcagaatttattgtcctattacctaaagtaccatcatcaatcgcttcttttggcgtcccaataacttcggcgattttctctccatttttaaaaaacacaaatccaccattttccatttttgtccaagattcatttttggttaaaggaaatgttgtgatgatattgaccttatctcctgcttttgcataatagctaaaatcaattactccatcatcatcaatacggtgagctttgccaaaaggtgcttttcgcataacataatgtaagtttgttgagcaatgtgcaatcatccactcgccattagaaagaatgaaattaaacgtaccgtgttgagcaagtccttttgttactttttgaattgcttcaaaaatttccatttcacttggttttttgcggaaagtgtttttaagatattcagccatataacagaaagcagcttcagaatctgtagaacctattggctgtaaaaaatgatctgtcatatctggtaagttttttaaattaccattatgcgcaaaaacccagttttgtccccaaatttcacgaatgaacggatgggtgttttcaatattgacttcgccttgtgttgctttacgaatatgtgcaataacattaagagatttaatattatattgttttatacaatctgcgatgggggaaagactggctgcttgattatcacgaaaaatacgtacaccacgtccttcaaaaaacgcaattccaaagccatctgaatggcaatctgttaaacctgcacgacgacggaaaccttcaaaagraaaaacaatatccgttggcgtattgcaattcattccgagtaattgacacataactttaattagatataacctcacaatatgtgagtgatttaacaccattatagggagaatatcaagagagatttaatgaatttttatgttgtatagatattaatgatagaaatcttatttaatctattattctttaaaaatcgagatttaacagtctctttcggctgatgtattgtggtacaagcaaataaactcacaaggaaaacmacaagcaatgccatctttaatttattcataaatacnaaattccgagaaataagnaagcgcgtatgatagcggaaattggggattgtgcaagggattggaatgagactaaaaaaccgaaataaaaactggaaatgtaattccaaatacatcaagaaacaaataatatggaaatcaacttccaattttcgtatactttttaaaatatgaaattaacttccaatgagtaaagctatgatctctcgtgaaaattatttacaacaactgattcaatttaaagatactgattttatcaaagtcatctcgggtgttcgtcgttctggtaaatcggtgttactcatgcaataccgtgattatctgcagcaacagggcattgcttccgaaaatattctttacctcaattttgaatcttttgaatatcaatgggtgaaagacgctcaagacttccaacagcttattcaagaaaaaatgccgtcttctcaagagaaaatctactttctgattgatgaaattcagtttgtagaaggttggcaaaaaatcgtcaatgcgcttcgcgtgagttttaacactgatatcgtgattacaggttccaatgccaacttgctttccggtgagcttgcgacgctgttaagcggtcggtatgtagaaatcaaaatttacccgctttctttcaaagaatttttgcacgccaaaaatgtggatagccaatcaagattggtcgataaactctattcggaatatgaaaaatatggcggtttccccagtgttgtgatggctgatgagcctttaaaagaaacgattttatcgggtatttttgattccatcgtgctaaatgatattgcccaccgagctggagtgaaagacacgcatattcttaaaagtgtgattctctttttagcagataatgtcggtcagttggtgaatccaagcaaaattagcaacacgctcacgtccgaacgtgtccccacttcaaaccataccatcagcaaatatcttgatttgttagaaaatgcgtttcttttttataaagcaaaacaatacgatattcgcggaaaaggctatttaaaaaccaatgccaaatattttattgtggataacggtttaagacgacatgctatcggcaaaaaaggcgcgaattatgccaatcgactagaaaatatcgtttttattgaattactcagacggggttatagcgttgatgtgggcaaactcgacagcaaagaaattgattttatcgctcgaaaagccgatgagattttatatgtgcaagtcgcctttgaaatacctgaaaatacccacgaaacagataatcttttgcatattaaagataactataaaaagatcttaattacgggcaaatattacgaacaaacggagattgatgggattgaagtgatttatgtggtggattggttgctgcaataaatccaaaaacgttggaaattttaaccgcactttttgtgattaatgtttgtggaggcacgtgttttctaacgcgcaccaaagaaagtaaataaagtgcggtgagtttttgaagtgttttttagtgaaattaggtacacgctaggaagcgtgcaccaacagattgtgctaataaggraagatagcgccagcgtcctcactggtgctgtttaataaaacattgcgaattttacccgtaagccactggcagaaccaatattcaaaattctttggattttttgaccgcacttttagttgataggcacaagagaggacgcttgtgccattatggagaaacttcatataaagttatactatgctatactacgtccctcgcagggagaaaagctatatgaatataaaacctcatttatttgggcttaatcgctcaaatcgtgatttttcattaagagaaacttggggaaaaaatcaatttaattcttcatttccagtttctttatgttgctatatgtcatcaaaaggcatacttgctaactacttgtctatagaaaatgcagagataaagtgcagttctatcgatataaaagatgtttttgaaattgaacctgagaatgaaaatacattttttgcatttgaaacatctcattcaattaaacttacagcattaccggatcatacaacttgcgatctaactgatgcagattttggtagtgaaatagtcattcgtccagatagtattgtttatttagcttgtagtcttgctgagattttaaaggaaagtcttgctaattgtatggatattccgaataacgtagatcacttagattggtcagaaccaaaacaagttataccattatttcctcatatactatcaacattaaacaacctttgctctagagcagatactattcagactccctttttgttacagcctgtgtggaaaactttaggtaaatctcctagattggctgataactgtctagatatttttatatggagcgatgtagcatttgtcaaatttattttagaaatatcgaatttaaatgtaaatgttttatcaattaatcgacaaactagaacggctatttggctatataaaatgttagttgatatagtgaagtatgggcgttttaatcaccataaaattattgatttgtgttcttataatacaaagaatgataaagcttttgcttcctctggaatgatcacaaatgtctttatgaaaagtgaacgattagaacgtcctataataatgaagtctgaaataaagaatattatcttaggtggaggacaagaattacttagtccagaacgacgttttgatgcaattatttacaattcttcggagttatttagatgaagtgtgtagacttattttcaggatgtggaggtttatctcttggttttgaattagctggatttgagatctgtgcagcttttgaaaattgggagaaagctattgagatttataaaaataacttttcacaccctatatataatattgatttgagaaatgagaaggaagcagtcgaaaagattaaaaaatacagtccggatttaataatgggaggtcctccatgtcaagatttttcaagtgcggggaagcgagatatatctttgggaagagcagatttaacatatagttttgcaaatatagtgtgtaacattcgtccaaaatggtttgtaatggagaatgtagaacaaattaaaaaaagtcatatattgcaagatattattaatcaatttattgattttggttatgggttgacttcagctatattagatgcctcttactgtggtgttccacaatctagaacaagattttccttaattggaaaattaaatagtgaacataattttctgattccaacattgtctagaaaattatcagataagcctatgacagttagagattatttgggaaattcattaaatctagagttttattatcgccatccaagaaattataatagarggggaattttttcaatcgatgagccaagtccaacgattagaggtgtaaatagacccattcctaaaggatataatataaacagttgtgatcctaaaggagttgagttagcaaaagttagaccattaacaacaattgaacgcagttatattcaaacatttcctaagtcgtttttattttcgggaacaaaaactgatttagagcaaatgataggtaatgcggtaccagtaaatttagctaaatttgtagctagtgcaattataaactttgaaaaagaaccaataagatctatgggataaattgatttatttgaaaataaagtatctccttttattttatcagagaaagtgctgcataagataaaagaacagtatatatatcaatgatcttttatattaaagaccccaaattatttacccaatttggggtctttattttacatttctacttcatcgctacacccaaccatttcatcatctctctctcatcccaacctttacgtttggcataatcttgagcttggtcttcatcaatgcgaccaagtgtgaaatagttgctagcggggtgagtgaagtaccagccgcagacagaagcggcaggccacatggcgtagctttcagtgagtttcatgccgatgcgttgttcgacttctaataaatcccaaattaaggctttttccgtgtgttccggccagcttggataacccggtgcagggcggatgccgacatagttttcgttgattaaaccttgattgtcaaattcttcttgcgtgtagccccaaatgcgggtgcgaagctcaaagtgcaggtattctgccatggcttcagcgaggcgatcgcccacagcttgtagcaagatggcgttgtagtcatcgcctgcggctttgtagccttccactagctccatttcttcaacgccgacacacacggcaaacatgccgaaccagttttttttgccactttggcgatcggcgataaagtcgcttaagcagaagttaaatgggcttttgctgtttttgccacgttccgtttgttggcgtaagccgtaagcggtgccaatggtttgtgtgcgttcttcatcagagaatagcaccacatcatcgcccacgcgttccgcagggaaaatgcctaaaatgccgcttgggttgagtttgtggttttgttctaattcatctaaaaccacttgtgcatcgttccacactttgcgtgcttcttcgccaccttcaggataatcaaaggcatccggatagcagcccatcaagccccaaatacggaagaatggcgaccagtcgataaatttacgcagttcggcaatcggtacgtttttaaattccacaatgcccgtttgttttggcgttggtggcacgtaatctgcccattcaccactaaagccatcacgtgcttcttcaatgctaagctgtttacgtagcggtttactatttgcaaaagattgttggattttctcgtaatcctttttgaactgttcccacaatgctgcacgcccttcagggttcattaaggtggcacatactgttaccgcacgggaagcgttagaggtatagaacacacagtgttgtttgtattttggataaagtttaatggcggtatgttctttggaggtggttgcaccgccaatcatcacaggcaggtttaagcctaaacgagtcatttcacccaagaagtattccatctcatctagagaaggggtaattaaaccacttaacgcgatgatgtccgttttttgattaatagcggtttgaataattttgtccgctggcaccatgacgcctaagtcgatcacttcaaagttattacattgcatcaccacactcacgatgtttttaccgatgtcgtgcacgtcgccttttacggttgcaatcaccactttaccgttgcttgaacctttttgtttggttgcattataaatggttctaaatacgccacagattgtttcatcacgcgtgcggattttaccacttgcggcaggaacattttaccatcgccgaataaatcgccgactacgtccatgccagccatcaacgggccttcaatcacatctaatgggcttggtaatgtttggcaagtggtaatccctttcacaagggcgtgttttaaaagttctcccactggccaagtgcaccattctgcgacagaatcgaccgcacttttcttaaacttctcacctctaaaatcgtcttctgtcagtttatatttttggatcatcgtccccatcgcaccgtctaaaatgagaatacgattttctagagcttgtttaagttgagcggttttattcaccataattattttgttctgtaaatcttaaataaataactacggaataataggtgtaagggctaggggtgtcaaatgttagaaggaaagtgcggtggaaaattaaggttttttatttaagtgtaatggctgcgacaaaacaggtaattttacattctccgcacccattgcaacgttcattatcaatctctaaagtgctggagattgcttgtagtgggcaagcggtttggcagtctggacaggtttgattttgtaggattaaacaggctgaggaaaattgtggacgaagtaatgtatctcctggaaaattaggatgtagtgcatttntcggacaaacttctgcgcatttaccacacaaatcacaaggtgcgtagtcaatttcaagggtggcttgttgctgttttagttgaattaaaccattaggacaagctgaagcgcattccccacaaccattgcagacggcggaaaataaatcttctcgtgctgaaaagggaggacgagactgcgttttttctattgttgattttgtagctggaaatacatgacgcaatagtcctctacgagaaatgtgatggtggcttaaataagcctgataataggcttcgtttttcattatcgataaaatcttactgtcggtacattaatatgtaaatctacttgccattgttgtaaagtttttatggtaagtaatgcaagagcttgataaaaatcagaattttctattttgcttagttgttcaaggaaatgatacgcccaagttaagaagtgttcacgtagaaatttggttaataagtgcggtcgattttctgctaaatatgcagcaagcattagcattaagccaatatgatcttctggttcatcttgttgtgtttgaaatgcgatttgatgttgttgtaagaaatcgcgtaatgctaagagagaattaccaaaaataacacattcaggatcaagatatacggatccccaaggtggcgtaggtaattcatttggaccaataaataaatactgatattgttcagtgatattttgttgcagccctttttcaataagtgcggtgatttttttatgtgtttttacatcaaatgaaatttcccattcttgcatccaatttggttggcgaaagaatgtcaaaatatcagtaagtcgtgcatcattaggctcatagtaaaatactgcaccgagtaaacgcccataaatagaaatttgttgaagagtattttgcatagtatctccgaaaacaatttgtcattagtgaatggggatatgaggggtagttaaatattactaattaacgtttctaaaaattgaggcgtatgctatacgcctcaacataatttaaccaccaatcgtcataccgtaagtcatatgtaatccataaaataatacgcgaccgatgccttcagctactaacgttaatagaacggaaatacctaatagtcctatgtttttcactcggaataagaggaaagctacaatggaaagtaaacataagcgagttacggtcattatggcataatttggtacgaggtcagcggcattttgaatagcactgtgaatattgtgtaaattgaagccttgatatatggctactattgcgaccaatgataccccaatggcgaataaacttggcagatgctgaagctgatattcacgttgtttattagggattaataacgcatagctcaatgttaatccacctaatacaacggtaaggtagaatgaccaagaggttaatgcattattccaagttggtatgcttgtaatatggtaaacctgattcattacatacataaatagtatgccgataagggcggtcacaattcgccatacatttccaagtgaaactggcattttacctaaaattgcaatcagccagtagaaacctgctaatgtgaaaaatattgcaccagcggcaatttcattactcatcattgatgagccgactcgattaagtgaattaaatgcacgtataggtaagccaagatgcataatggaagcaataaatccaatacctagtaaagccaaaatcacaaacattactttatgaatataagtgcgactttttgtatttttctcatttaatagtacaaatgtgaaaacaagccaagcaccgaccgcactttgtgccaaaactgtaaaaaatactaatggcagttcatataatcctgtattcatcttacacctctcttgggtttcctaagaacccacttgtatcgccacttaaacgagcgtatttattgggttttaccactaaatttggttgagtgatatcagtcggtggtagtggtgcgatggaggcttgtgtgccatattttgttcgaagttcatcaataggagcgaaatccaatgctcgtagtgggcaggcatcaacacaaatcggtttttgacctgattttacgcgagaataacatccatcacattttgtcatatgacctttttgtgcatcatattgcggtgcatcataaggacacgccatatgacaataacgacaaccgatacaaatttcttcattgacgatcacgaaaccatctgcatttttgtgcattgcaccagttgggcaaacttttgtacaagcaggatctgcacaatgattacaagaaatagacatataataggcaaatatattttgatgccagcatccatctgcttgttgattccactgaccacctgtatattcataaatacgacgaaaattgacttctgtgccaagatctttgtaatccttacaggctaattcacaagttttacagcctgtgcaacgttcagaatcaaaataaaaaccatattgttccataattctccccctacaaacgttccacttgaactaaattagaatgttgcggattacctttcgcaagcggtgatgggcgttgtgtcgtaagtacattaatgcaacctgaatgatcgatacgatctttatctggtgcataccaagccccctcgcttaatgccacaacccctggaataatacggggtgtaatttttacattaatatgtacttcgcctcgatcattaaagatacgaatcatatcgccatttttaatattacgaggttctgcatcaataggattcatccaaacttcttgtggattagctgcttttaatacatccacattgccataagttgaatgggttctcgctttatagtgaaaaccacttagttgtaacggatatttttccattaatggatcaccgtaatgctcaaaactttgggcgtgaataggtaagggatgaattacgtcatcttctgctaatttccaagtttttgctatttcagctagacgagaagaataaatttcaattttgccagatggcgttttaagtggatgggcttctggattatcacggaaatctttgtatgcaactttaaagccattaggatcaacttttttaaaaataccttgttgtctaaattcttcaaaagtaggtaattcaggtaatttttctcgagattgctcataaatatggcgtaaccattcttcttgtgttcgtccttcagtaaatttttcctttacgcccattttctcagccaaatcactcaacatatcgtaaataggtctacattcaaaagatggtttaatcacttgatctgcaaaaatgacatatgccatattggatacaaaggcatctaaagcgaaatccatttgttctgaagttgtacaatctggtaataaaatatcactgtatttggcagtagatgtcatatgattatcaatagtaatgatcatttcacattgcgtatcatcttgtaaaatatcgtgagtacgattgatttgtgcgtgttgattaatcaaacagttacttgcgtaattccaaattactttaattggggacgataatttatcaacaccacgaataccatctgtaagtgcggtcatttctgtgccacgaataattgcatctgtccataaaaacattggaatgcttgctttcacaggattttttagcgttggcatccgtacaaatggaatgctatacgcactttcacgtgcaccagtgttaccgccgtgaattccaacattacctgttaagattggcaacatcgcaatggcacgagagattaattctccattactacgacgttgaggcccccaaccttgggaaataaaggcaggttttgtactaccaatttcacgtgcgagtttaataattctctccgccggaatacccgtgattttagccgcccattctggggttttagcgataccatcattaccataacctaaaatataggctttataatgaccatttttaggggcatccgtaggtaatgttttttcatcataaccaacacaatatttatctaagaaaggttgatccacgagattttcttgaatcattacataagcaagggcagcaacaagggctgcatcagtacctggacgaattgggatccactcatcttcacgccctgcaccagtatcattataacgaggatcgataataatcattttggcattggaacgagctttggcttgttcaatacaataagttaaaccacctccactcatacgagtttctgcaggattattaccgaataacactattaatttggtgttttcaatgtcagccattccatttcccaatgcccaaccaccaccataggtataatctaaaccgacagcaatttgtgcggtgctgtaatcaccataatggtttaaatatccaccaatacaattcataaaacgagcgatcatagtggatgcaggtggccaagatttagccattgtgccaccgagtgttcccgtaccatagtttaaataaattgattcattgccatatttttttatattgcgtttcaatgcgtctgcaatttcagttaaagcctcatcccaactgattcgtttgaatttgccttctccgcgtttacctatacgtttcattggatattttaaacggtctgggttatatactcgacgacgcatagaacgtccacgtagacaagcacgaacctgatgatcaagattatatgtttctgtccccgtattatcggtttccacataagtgattcggttatcttttacgtgcattcgtaatggacaacggctaccacagtttactgtacaagcactccaaacaatacgttcttgattattttcattgaggcgttgtgtctctttagccattacattgaaaggtaaagtaagatttgaaactgccagtgcagctcccgcagatgacgccttgacaaaatctcggcgacttatttgattaaagttactcattatatcgttcccccacagtcagattgraaaataactaaaacgagttaattataatctttgtatagaagttttacttgagccaaatcaattaatcattaataggtatattatttatagggtattttagtagattgatgttttaataaactttggaataacaaattgactatggatttaaaaatccgttagcatagtggcgtgttagtttatctaatatgttaagtttaactattattaactagaggatcttttcatgaagaaacttatcgcagttgcggtgctttctgcatgtggctcgttagctcatgcaaacactaatattccaaactacaatacagacgcccatctttacgaattcacgcaaacctatgatttagttgtgccaaaaggctcgcaaggacaaaccaatttatgggttccattaccatttaatggggaataccaacaagtgaaatcgattcactttgaaggtaattacatgaatgcctatgtaacagaaaacaataaatacggagcgaaaaccttatttgccacttggaataaagatgcacaaaagcgtgatttaaaagtcatgatggtcattgaaacaaaagaccgtgaaccgatggtgaaaggtgctttagagaattatactccgccaaaagatattcagtattccgtggatgtacaagaatacttaaaagctactccacatattaaaactgatggcattgtgaaagawtttgctgacaaaatcctaggtaaagaaactaatccattgaaaaaagcagaacttattcaccactggttcgtaaaaaatatggaacgtgataatyctgtattaggttgtggtgacggcgatgtagaaaaaattcttaccactggcgtgttaaaaggtaaatgtaccgatattaactctgtatttgtggcacttgctcgtgctgcaggcatccctgctcgtgaaatttttggtattcgcttaggtgcggcagagaaaatgggcaaatattcaaaaggtgccttcggtagtgcaaatgaacaaggcatcgcaaacgtaagtggtggccaacactgccgcgctgaattctaccttgcagggtttggatgggtaccagttgattccgcagacgttgccaaaatgcgtttagcagagaaaaaatctgttgaagataaagatacacaagccgtagcaaaatatttgtttggtaactgggaagcaaactgggtgggatttaatcatgcccgtgactttgatttatatccacaaccagaactggctccaatcaataacttcggctatccatatgcagaagtaggtggcgatccgttaaattcctttgatccaaaagaatttaaatatgactacgtctctaaaaaactctaataaatccttttgggttgccatagcgccgactaagtgctgcggtggcatcaaccttgtgctgcatcgcaccattaatttatttagtatttggtgtgtcgtccacttggttgattggcttaggcgaatatgattatttgcgtattcccatgcttattatttcattatgcgcctttgcctatggattttggctgttgatgttttccaaaaaaatcatttgtagcaaatatatttcccgtaaaaaactcatcgttttatattggattgtatttattgtgatgatttttttcttaacctatccaacaattttgccttggattttagaattagctaattaggaataaaaatgaagaaattatgtaccgcacttttgctttcgctgtttgcaatctctttcgctcatgcgaatgaaaccaaacaaattgtgctaaaagtaaaggaaatgaattgtcagctttgtgcttacttagtcaataaagaactgcgtaatatcaatggcgttatttcaacaaaagcatctattaaagatggtttagtgacggttgtggaagatccaaatgtcacaaaccaacaattattcgatgcaattcacaagctgaaatatactgctgaagtcgtgaattaaacgctaaatatctagcaaaaaagtgcggtaaaaattcaccgcacttttctttagctattaaattagactaattttttaattagtttgattacagtacaattaattaaatatgataaatgcaatattattcagcactttcgcttaaaaatccgccactttgatgattccaaagtttagcgtacagaccattgagctctagtaattcggcgtgcgtaccttgttcgacaatttgtcctttatcaagcacaatcaggcgatccatcgctgcgatggtggataaacgatgggcaatggcaatcacagttttattttccatcatcttatctagactttcttgtattgccacttccacttctgaatccaatgcacttgtggcttcatctaacaatagaattggtgcgtcttttaacattacacgagcaatggcaattctctgacgctgaccaccagaaagttttacccctcgttctcccacatgggcatcatagccttttctaccttgagaatcactgagaaatgggatgaaatcagcggcttccgctcgttcagcagctaaaaccatttcttcatcagtagcattcgggcgaccataaataatattgtcacgtacagaacgatgtagcaaggaagtgtcttgagtgactaaaccgatttggcgacgtaagctttcttgttgcacattgagtacattttgtccatcaatggtaatttcgccttgttgtgcttcataaaagcgaagcaataagttcacaatcgtagattttcctgcaccagaacgaccgattaacccaaccttttcccctggtttgatagtgagattgaaatgattgagtaatggttttgtcggatcgtaagcaaaggtaatatcgttaaacttaatttccccttgtttcacttgtaacggtgacgcttgtggtttatccacaatagtgtgaggtttggttaaagtattcattccgtcgtttacggttccgatattctcaaacaaacgggcagattcccacataatccagcgagaaagcccatttacgcgtaatgccattgccgttgccgttgctattgcacccacgccaacttgaccatttttccataaaataataccaagtattgcagtacttaacgtaagtagaatatttgtagcgtaagtgagtgtatctagtgatgttgctaagcgcatttgggcgtgtactgttaccataaaatcttgcatagaacgcttggcataagtagcttcgcgtgagccgtgagaaaataattttactgtagcaatattagaataagcatctgtaatgcgtcctgtcattaaagaacgagcatcagcttgtcgttgtgcggtttttgatagtttaggaattagggttcgtaggatcaaaccgaagagtataatccaagtaataaatggtaataagaaccaagaatctaatgccactagcactacgccagaggtaataaaatataccaatacataaacgaacatatttgcaagtgtaagtactgtgtcacgtactgcaagggcggtttgcattacttttgcggatactctacctgcaaattcgtcttgataaaaacttaaactttgtccaagcattaaacgatggaaattccaacgtaatcgcattggaaatacgccttgtaaggtttgtaaatgcacggccgaagctaaaaatccccacacaatactaataagtaatagagcagccattccaattaataaatgacttttttcttgccataatctttcaggtgtaaatgtgcctaaccaatctacaagcgttcccataaattggaataatacagcttccattacacctgtacctacggttaaaattgcgagcaaaaaaatccagcctttcattcctgtaatactagaccaaataaaacggracaaaccttttttaggtgttgttggattgctttctggatagggatttaaacgattttcaaaccacgaaaaaattttgttaaacatatcttttccttaaaaagaaaggcaacgcaggttgccttttagaagtgcatattattatagcacaaaaacaaatcaatttataggctgacagattttctgtattggcttggagaaagttggtagtaatttttaaaaactttacaaaaatgagcttctgattgataccccacttctaaagcaatggcaagcacagattgttgtgattgttttaataaaaacgccgcagattgtaaccgcactttcgtgagaaaacgtcctggcgacataccaatatgttgttgaaagatacgaataaagtttgcacgagacattgttgcaagttcagctaattgttcaatatgccaatcattttgaggttgttgtaatattgcgatcagtgcagtatttaatcgcttatcttgcaaggcaaataagatgccttgttcaattaaattttgttgaatagcgtggcgtaaaatataaattaaaagtacatttgaaagtgcatcaacgacggatttcgtacccgcatcatttttttgcgcttcttgtaaaaaaagctgtactaaaggatgaattggtgtgtcgcataaatttatatgtaaatattcaggcattgatgctgtaagaagcgcatcttgttgataataaaaattaccgcagaacatttttaaatctggtgtacctcgtccaatctgatgtaactcaaataatccttgatgacttttttttgtaggaatatccgctcttttatttgctgaataatgcatagagtgcggttgattttgaggaagaaaaaaaacatccccctcttttaaatgaaattgtttttcatttagtgtaagccagcactcgccttgttcaataagatggaatatgcctttycctgcatccttttcttgatgagatatttgccattcgccttgaaattcacagcgaatattaatttctccacgcacttgtgctaaatgggtaagtttatctaaatagtccataatgagatgttagcgataaaaattgagataaataagcaagtatcataatctaatccgcctataatttgccacaccagttggttattaattcaatatatttaggagaacattatgtttacagattggaaagaacacacatctcacgttaaaaaatcatttggtgaattgggtaaacaataccctaaaatgttacaagcttaccaagcattaggcgcggcagctgcagagggcaatgtgcttgacgctaaaactcgtgaacttatcgcattagccgttgctgtaacaacgcgttgtgaaagctgtattagtgcacacgcagaagaagcggtaaaagctggcgcaagcgaagctgaagttgctgctgcattagcaacagctatcgcattaaatgcaggtgcagcttatacttattctttacgtgcattagaagcatatagcgtacagaaagcttaattactcatcattccataaagttaagttgattaagagaaagggagcatttttttaatgctcccttgttttgttaaggttgtgttttaataatacaccactctatttttcaagcgatgcctcccctaaagggaatgacttcgtaaattgttcatattcttttggatttttctcattgtcagtaaaaaacggcaaaccgatcaaacgataatgcggtgtatctttttgcagaatcttatccttgccatattctgctgtgatggcttctaaaaattcttttttccacatatccgtctccactaaatgctcacctttgggttcaatgaaaatttggtaatgcaaaaagtcgtttacaccattggaagaagatttttgtttgtctttcagcaataaaataaagtccggcataaatccttcaccatcagcaaagttattcaatttaaacacttcttcattacggattaaatgaacatcatatttagacttcaaatcgcccaaacgctctgaaataaattgaattaacgcttcttccaaactcgttccagsaaaattatccatcacataccaatcattttgcgtggcaatggcagtttttacatcatcttttttgacccatttttgttttggtgtgccaaaaatttcccataattttttaggcgtaaattcttttgtaccgataaacggtatatcactttcattgagatgtttttcaaccatttccaagattttcaggcagcctgcaagtttgtcatctgggctaatctgtttatcttgccccaatcccaaaaattcaatttgccaatcttttaacaagttattttgcaattcattgcgattttgaatgttgagtttgctttgtaagcggtcaaaatggaataaagattgactattttttcctttgatatgcaaggctttattaaaaatgtgccgctctatttcactcatttctatggtttcagtaaaattattttgtgtgccgatttgtcgggctttttcatcattttcatcggctgtaaattgcgtttcttgcaacaatttgccgtgaactgggaatggaagcggttgcggtggcggattggcttttaggctgtctgcattattggctttggcattgggattagggatttttttattcgcccaaatcaataagtttttaaaattttcattatctgcaaattcagattttagtttgaatgtggttaaaactttatctttatcgttttcgggaataaagccatctttgcgaagttctgcttttaattctgaaatatagcgagattgctcatcgtgcgtgtaataaaacaattcttccaaaatacgcaattcgtgttgcatatcgttgtcaaatttgcgtttattcggctgtttatcttcaaacgcaaatggaaaataacgcacgccacgaccaattaactgcttttctgatacggtggcggcagcttttgcccgattttttatttgaaccgccgccgttttgcccttcatacaaacgcacaatatcaaacaaattcagaacgtcccaaccttcagttaatctgtccaccgtaaaaatagcacggntcggattatcagccgcttccaaattatttagcaattttnccgtttcactgtcggttttttctgttttgcttttgttggtttcggagttggtgataatgacattgtgtttttgataattttgttttacccaatctgccaaatgcacaaactcaaatttattgtcctgtataaattttagggcttgttcggtacgggttttgccttgttcgttggcgttatcgctatcgtttaagcttgccaaaaatgtcgttaaaaacgaaaaatcaaccgcttgcacattttctacccaatttaaaaatgccaaataatccgcctttgattcatcaatcgtcttacttctaaacaacatcacaggcttgaaattggcaatgccatatttcaatgcaatttgatggcgataccaagcaaacaataaagcgtgcaatactcgctctttcttgcccagcgtactggataccaaattgatttctttggtataacctttttgcaaaaattcttttaaaccaaattttgtgatgattttatcagcatatttttgttgcacttcagcattttcaggcagtgtggcggtaaattccaacagcacattttcgctgggattgccatttttattgagtaacaattccaaaaccatatgctcccagcctttgcgttcaatttcggctttgctggtgcggtcgttcatttccttttctaaatctaattcgccttgttttttgcctttggtttgcgcgtttaaatggtgtgcttcatcgcccagcatcacaaggttcaaatcgtgcagatccgtcaatgtggtttgattttcctgttcggtgtgaatatcgttatacagtttttgaatgctggtaaatttaatttcaatgccgtctgaatgtgggctaaacgtttccactttgcgaatgggaattaccgtatcgccctgcaaaatcttctcggtaaataaaaattttgcgtgcgtcggatcggtaaaattattttccgttttatccacgatattgttttgattcacaaaaaacagaaaatgccgataccctttttcaaaataatacaaaatcaatgccgccatcatcatcgttttgcctgcacctgttgccatattgaacagcaaatgggtagggcggtttttgatgtcagggaaatcctttaattttgaagtgcggtcaaaaatcaaaaagttttctaatgcggacttttgccattcaaaaaatggatattttaaattgcgttctacaaattcaggcagtgcgaaaaaatccgtctgctccatttcttctagggttgatttgcggtcttccacccaatcaaacaaagttttatcattcgccatcttttttctccgcttgatagaacgcacggcttaacgctttatcgtcatcatttaagcatcctgcaaattgttcatcgtccatttcggataatgaaacatacatttgatttaaatccaacatttcaagcaccatttgtttttgttcgtctaatggcaaagattgaaattcaggctcttcaataatttgactaaattctttcacgctgacgttgtattttaggaaatagcgttcgcataaatcttcaaacagcgttttgatgtcgtctgaatcttcgcacgccaaaatttgttgttttgcggtttcgttaaatggagcaagttctgcataaacaaactcgccaccaccttgccaattcacggctttggatataccgccttgctcgccatcaatcacttttttcaagcgttcaacggcaagcgtttcaatataatccatttgttcaatgccgatatattggcggttcattttgtgagcaacggcagcggttgtaccactgccaagatggtagtctaggacgatgtcgccctcttttgttgtcatatcaattattcggcgtaataaggcttctggtttttttccatttttaaaatcaatatatcccccctctttatttagattgttatattgaatatcgtcccatagtgtattaaccttttgtaagtaaaaatatttatttttttctttgattagcatatcagataggnacataaacatatctttatttgaagcattgtaaaaaacttctataagattacctgcgtttttacccttttgtggaatatactcaatgctaacaataccattttttatggaatataaatcttcaattatcttgcttctgatgctagattgagcatttgtagttctataaactttatgtgaatactccgtataaattatttcttttgataaattttgatcttgtgaaaatttaacaattgaagtcatctgtgcgttaggataatgataatatttgaagccatccttttcttctaaaagtattttctcacctaaatcaataagaacctgcgtatatttccaactttttccactatcttcatagtttttaataaactcattaacttctgttttctgataaactgggttaagaaataatctttctctattttttgaaaaaacattaataaattcagtagaatcttttaaacttttaccttctgaacttcctgatacaccaccaattttggttttaacagtaacaatattcaaaaaattatctctatcaaaaatatcatccatcaatattttcaaataagcttgttcaatgtcatcacattgaacaaaaatcacgccatcatcagctaacaatgttttcgcaatttccagccgatttttcataaaagtcagccaagtggaatgattaaatttatcgttgtatttgaaaccgtcattgcccgtgttatacggcgggtcaatataaatcagcttaactttacctttaaactgcttggcaagcgaatgcagggctattagattattgcctttgataatgagattttcagcaggcgtgccgtcagaatggcgttttatttcgccaacggcttgtttgccgtctgcggtatagcgagagaattttgagaatgcttttgcgtcaaaaagccggtcaatttcatcaaaagcaagcgtttgattaaaaaagatttcttgtctttttcgggttaatttggtgtataattgactgactgactgactgactgactgactgactgactgactgactgactgactgactgactgactgactgactgactgactgactgactgactgactgactgactgactgactgactgactgactgactattattgcgtttaaaataaatttcttcgccttcttcggtgctttgcccgccattcaatacacaatctttaaacggaaaatccaacacaatatccgaactgtctttcaaaaagcggttgccgtccgtcaagccaatgcgattggcgtattttgtgtaggaattattgatgctgtgtttgtccaagaaaaaacgaaaatcctgcaatttaaacaccaaaacaccattcacttccacaaagaaatggcgttttaaatcatcattccccaataacaaaccgatgatggtcgggtcggttttttccaccaaatccaacagaatgtttttggctaaaatggttttttcttcgttcgcccatactttttcgtgtgatagtagggcttgggttaattcggtttgaatgtctgtcttcatcgttatcaatcctcataagtcattattttaatgtgctattacaaaggaatagcagagtgtttaggtatatttatcgaccgcacaggtttaattactctcttaaccagttttctttgactcacagaagtcaaaaaattttgtttatgtgcatcaaattttagtgaaagcattaacacagtattaaaacacagcctttgttaaaccaaattagcattctaaaactgttctagtgctttttttactggggcaaagctacgacgatgttgcggtaacgcgccaagttcagctaatttttccaaatgtaatttggttggatagcctttatgctgggcaaaagcgtattctggatattgcttgtctaattcttccatttcttggtctcgtgcaactttcgctaaaatagaggctgcactgatttcagccacaaggctatcgccttttaccacggcttgcgctggaatagctaaatcttttgggatcttattgccatcaatcaacacaaagtgcggttgaatttttaaagattttactgctcgagtcattgccagcaaggaggcttgcaggatatttatctcgtcaatttcgtcagcttcagctcgacctaatgcccaagcacgggctttttctttgatttcttcagcaagggctaaacgttttttttctgaaagttttttagaatcagctaatccttcaattggattatgaggatctaaaatcacggctgccgtgacaaccgccccaactagagggcctcgcccaacttcatcaacgccagcgatcaatttatagccttgtggatattcaaacattttcttttccttctaataaatcaatgaccgcttgagccgcttgcttatcggcattgcattgaattttttggtgtaaatccgtgaagtgctgaattaaaacatggcgattttttaccgcactttcatcatcagaaagataaactgatagtttttcagcaagcaattctggcgtgcattcttcttgaatcatttcaggaacaagcatttcattcgcaagcaagtttggtaaagaaatataatcagttttcactaaacgttttgctaagaaataggtcagtggtttcattcgatagccaactaccatgggggatttacaaagcattgcttcaagtgctgctgttcctgaagcaagaagtgttgcatcagctgcgatcattgcttgtcgtgcattgccatcaattaaatgcaggtctagatttggcgtaattttagctttaatggtttcaaattgaattcgtcgtttttcgttcactaaaggcacgaggaattgtaaatctgggaattgttcttttaataataaagcggtttttaagaaaggctcagccagaaattccacttctgaacctcggcttccaactaagattgctaaatagcgttgtgcgggatcaatctgtaacgtttggcaggcttcggcacggtttggtttgagcggaatagcatctgccattgtgtgcccaataaaacggcaaggcacattaaatttatcgtaaaaggctttctcaaaaggcaaaaaggctagaacttgatgagttgctttggcaattttatggatgcggttttgacgccaagcccatacagaggggctcacgtaatgaatagttttaattccgttcgcttttagtttaagttctacatccaaattaaaatcaggcgcatcaatgccgatgtaaacatcaggtttttcttgcaacatagtttgaatgacatttttgcgaattttcaacagacgaggaagatgttttaatatttcagccaagcccatgactgaaagctcttccatatcaacaagcgtctcacaaccttcagccaacattcttgggcctgcaatgccaataaagcgcgcattaggataatgtgctttgagctggcgtattaatcccgccccgagaatatcgccagacacttctcctgcaacaagagcaatggttggatttgttttgttcatcaaatttatcctaaaaaataaccgcactttggtgtgtaaagtgcggttgaaaatgaagaagttttattaacgaataatcccgcgagttgaacgtttgaaaaattcaacaaaaaaactgatcgctgaatcggtttccgcaatttgctcaatttctggtaacacttcttcaagtgttttaccgctacggtagagcattttataaatgttacggattacgtgcatagttggtttatcaaaaccacgacgtttcaaaccctctaagtttacgccaaatggacgggcgtggttaccttgcgccataacataaggtggtacatcttggcttaccatagaaccaccgcctaacataacgtgtgcgccaacaatcacaaattgatgaattgctgacataccgccaacaatcacgaaatcatctaattctacgtgacctgcaagcgttgcattgtttgccagaatacagttatttttaatttggcaatcgtgcgcaacgtgaacattaatcattaataaattgttattgccaatagcggttacgccacagccttgaatcgtgccacgatggattgtcacgtgttcacgaattttattgctattaccaataatggtttttgtagcttcgcctttgtatttcaaatcttggtttacttcgccaatactagtgaattgataaatttcgttatcttcgccaatcacggtatcgccacgtaccacaacgtgagatttcaatacagtgcgagctttgatttcaacagtaccctcaataatacagaaaggcccaataaaaacatcttcgccaattaccgcaccttcttcaatgagggcagttggatgaatttttgcacttgggtggatcatatttaccccttaattaacgacgagcacacattagttttgcttcacaagcgatttcgccgtttacggtggcaacgccagtaaatgcagtaataccacggcgttttttaatcacttgaacgtttaattccatttgatctcccggtaatactgggcgtttaaagcgcgcttcatcaatacctgcaaagtagaatagttcgccgccttttaattcgtgagttttaaaggctaaaatgcccattgcttgtgccaaagcttctaaaattaaaacgcccggtaaaatgggttcgcctgggaagtggcctgtgaaacaaggctcattgacgctgatatttttaatcgcttttaaccattcgccttctttaaaatccaatacgcgatccactaataaaaatggatagcgatgtggtaataaagtcataatttcttttgattcgatcacttttggttgttgttctgacacgttgataccttacaaaaaataaacaaataaaatctatcggattatacgatatttatagctaaaaataaaacgcactcaatatagcctagtgtttaggacgaatatcaatggctggatcgtcatctttacgatatttttcatcaattcgtttttgcaatccaaagtcatttttatccgactcgttagaaaataaatcttctgtttgcgttaattgaggatttttaattcctatccaatttgcgattccttctaagaagttcaaacctgatttaaacaccttatattctttgcgttccatatcatctgatgaaattttgaatagcggaatattatggtgctctcggctgaaacagttttgattgaacaaaagtatattgttttttcatcttgttggtggcacaaaccgtgatctgagaaataaatcattgaaaaagtgcggtgatttttcttcacgttttcttcaagctgatcatatacacgttttaaaaattcatcagttttcttaatagatgaaacatagcaatttaaataaccatatctcggattaagatctttatcatcaaagatttttggataatcttcgatacgatcgcaagccattgggtgtgaaccataaatatgcaacacaataaaacgttttccttgaacagaattttctaatacttgggcgaatttgggtaataaatcaaagtcactaaagttagtcgaattaaagcttccgccttttttcaagaaaaaggtttcatcagattttgatgcaagggatgaaactggcgtatcgaatttaccgatcatcccatgattagaaagccaataagttttaatgcccgcagatttgatgagatctactaaactcaaactgtaattgggttcccatttttctttgtctggaaaggttagcattaaacgaagtgaggcgacggtatttgttcctgctgaacgaaaaccatcaatcaacgtgcctttagcgttagacataaagggggtgttttcaattggataaccgtaggcatggtggtaatctttccgtgcactttctccgagtacaattacataatcatcatagcgtgaattttctaatgttgattttccccagttatcagattgagagatttgttttagtttttgcacttcatctacaatttttaatgtggaacttactgtttctttgagcggttcagcaagcggcatgttgtaagcaaaaagcaatgtcgccaaggcaataaatgttttattacgataaaattttatgccaaatttcaccgcacttttgtactgaagaaaaatcaaaataggaatggcgaaagcaattaagtaactactcactgggatttgcaatagaaattccttcgtttctaatatatctgtcgcgaaaagcgaggcgatatattggtagcttggagggccaaaatttagccctgtaggcgtataaaaagcatgcagtaacgtaagaggtagcaaaataaaatagaaggattttttactgctgcttaataagagaatagttattgtcgcaagcagaatgagagccacacttggttctgtaaacattccagaaccgattaaaataaaataacccgcgaatgcggcacaaatcactgcaaaaagtgcgggcaaaatttggcttgtttttttcgtgttatattgtcttccctgaaaagaaaatgtcgctattatccacctttcactgagaatttccatatttaacttcttcactcttgagcggttattttatagaataagccaattttttaagccagaaggaaaaaacaatgagccaaccaatttataaacgtattttattgaaattaagcggtgaagcattacaaggagaagatggtcttggtatcgatcctgcgattctcgatcgtatggctgttgaaattaaagaattagtggagatgggtgtggaagtcagtgtcgttctcggtggtggcaacttattccgtggcgcaaaactagcaaaagcggggatgaatcgcgtggtgggcgatcatatgggaatgcttgctactgtgatgaatggtttggcaatgcgtgattctttattccgtgctgatgtgaacgcaaaattaatgtccgctttccaattaaatggtatttgcgatacttataactggtctgaagctatcaaaatgttacgcgaaaaacgcgtagtcattttctctgcgggaacgggaaatccattctttaccactgattctaccgcttgtttgcgtggtattgaaattgaagctgatgttgtgttgaaagcgactaaagttgatggtgtgtatgattgtgatcctgcgaaaaatcctgatgcaaaactttataaaaatttaagttatgcagaagtgatcgataaagaattaaaagtgatggacttatcggcgtttactttagctcgcgatcatggcatgccgattagagtgttcaatatgggtaaacctggagcattacgtcaagtagtgactggtactgaagaaggcaccactatttgttagtgaatgttgaaaagaataatattaaagaaaatacataattaaattaaggactaaacttttaattcattgagtttagtctttttaatttaaataaagcattacggcaggaatgaaagttttcgtaaattctgtttagtcttcatagttggattatttagatataaaaatctgcactctaataagtgagaaagttaatcaaacttttagaatgcagattaattttttataaaatttcagtttaagctacagtgagttgtcccgcatataaaataaagaaacgtaaacaaaataccccaattaagtcaaaaattgataccaagataataaagttacgattgtattttaaacggtcatttacaaacatattggcgattaatgggatcaagataccaataatcaatactccaacccagaataccactccccaaaaaccagataaggcattatgtaacgcaactgttttttgtccgccaccaaaatgtaatccaacgaagaaacacacaatcaaaccaagttctgtcaccataattggcacttcaaatttgtggatgaagtgcgattcgtgagaatcaccttttagttttcctgcaattaagataattaagaaggttgcagcaataccagatgatgtgccagaagctaagaataatgcgggtaatactgggttatttaacattggatagctaatcaatgcagaaagtaagaaccctgtgtatgctccaagcacagcagccaatatgaaaagaataacttcgactggacttacaatacgttctgcaataccgatgagtttcatcacaaattgcagttttggtataaagcgattaattaatgcttcgatttcttttttgaaaatcactaccccccaaattactaaaaataacatatagatttggaatagcatgacccccatcgacattacggagttgaattgatagttaaacatcaatttccagaatgtccaaggtcgagttaagtggaaaattaatagcgttaaaccaattaatgttggtacagaccctaaaattaccccagatcgaataatccagttttggcttagattttctagtttattactgcgtttataggcaattgctaactgtaccgcaccagatgagatccccaataaaaacaagtagatcgcaatggtataatcccacactagattaggcgtatgaaatggaactggataatctaacgtcatcttctaggctccccatgttggaatggaatgtgatataagtttggttgtgtacctaattccactttagtgcgataaaccggtttttctttcactttacgtgaaactgcacttgttggatcattcatatccccaaaggttaatgctttggttgggcaagcctctacacaagcaggttgtttaccattggctaaatttgtatcgcggcagaagttacatttatctgcggtacgatgtattggatgaataaaacgtacacgatatgggcaaactgctatacagtattggcagcctatgcataaatctttatgtacatctacaatgccagtctctttatcaataaaagatgcaccagttggacaaactgctacacaaggtgcatttgtacaatgttggcaagattgacgaaagaactcgtattcttgatttggaaattccccataaggttcactacgtagaatctctaagcgagaaacgccttctggcacttggtttacatcacgacatgagtccatacaggctgtacaaccgatacacgcattttcatcatgtatcattgcgtaacgtttaggtttatctgccttgttttcttttgcaaaagcaggtaaagatgtccccgtcataaggatcactgcccccatgccagaaacaaagtttcggcgtgagcagactgtcatagtttatccttttgttcgattagtttatcttgttcagctttacgtttttgttgttcgccatgacaatctacacaaagtttaacgcgttgttttggttgaatacccttcattgcatcttctttagggtgaagagtatggcaacttgcgcaaggcaatttcattgcgtgtacatcatgagcccataatttttcacgaagtttgtcaggttgatggcaagcaaaacaaacttggttttgttcttgaacggaatacatcggttttttattaccgaaaatatctccttcaaaacgcataacatctttagcaccgcgacgatgattttcggaaatattgccgtgacagcttacacaagtaatagctttaccgttatttggatttttcttatctaaatgtgcaccgtgaaatttaccaaagtggagttcgccaccagactgatctagcgtttggtttttatctattttgtcgaatttatggcatttagcacaatattgattaggatcgcgttggttatctaattgcggttcataagtaacatgaaccgcaggtttttgtgcatcatccgcatgagccaaaaatggcgctgctacaaatgccacaattactaacgcttttgcagatttgttgattaaagaagttaaaatcatttgggttacctcaaatttgaccttgaaaatcaccgcactttctagtttgcactaaaaagtgcggngcatttttcatttatttttgtgctggtggatcaactaataagcctttttctctagcttgttgttcccattgtggtaccacagtttttaagaattcttctttcgctttacgttctttttcaatatcaatacccattactttccacgctttatcagcagttgaaatatctgggatttgaactggagttttcacaccgtgtttagttaagattactgcaagtttagtgcgtgcgtctgctactttatctaagccagaagctaatacacgaagtactacttcaggtgcatgcatatgaccaccatggcttgcagcagtgtaatcccaacgccattgagcatgacgaatatccattaatgctgcttccatttcttttttagttgcacctgcgtcccaagcctcttttgcttcaaagtgagctttgacaacttggtcttctaaacgacccattacatctttcacttcttttttacgtgaagtaacaatatcgcgtaatttttctttgctttgatcgtgacaatttgcacaagtgctgtcaaatgcctcaaatggattttgaatttggtgatcggtgtaaactttaccgtccgcaccttgtacttttggcatatggcaatctacacaagttaccccatttttaccgtgcatacctaaagaccaaatttcaaagtcagggtgttgtgcttttaacattggtgctttagaaagtgagtgagtccagtcagtgaaaccaatatcatcataatattttncaatatcatctacggtttgaccattatcccaagggaaagttacttgcttgatgtcccctgcaaaatagtattcaacatggcagtttgcgcaaatttctgcacgtttttcagtacgcgccgccgtgttgaagcttaaattgttgtgtgggcgaccttctgctttatctttttcagcagtggctttttctaaagcatcaagggcgcgtaatacgtgtgggcgagcaatacgtaatgcaggtttgccttctgnaaaatctttagaggttgtgtcgtgacagtcagcacagccaattgagttcacgatttcaggtcctccctttgcccatttcgcattgaaataatctttctcaccccattccgcgattaaacgtggaacatcaggacctttacatgtccaacatgccatagcttgagggccatcatttgcagtttttggcgcacctgtacgtaaaatattacgcacatctgttaccgcataaaagtgaccgcgtggtgcgttatattcttttgcaaatgcataaccaccccaaagtacgattaggcgcggattttcttcatcagcataaataatgttttcgccatcgccgtttgctgtagaacgccagctgttatattgatttggatatttttctgcaaatttttcatttacagattcaattttcaaatcaggttttgcgggttcaacaggttgttctaatggcttatatacaagctcagcagtggctgagttaaataagcttaaactcgcgaaagacgctgccacaataaggctttttttgaatgcgttcacgataattactccatttgttgtaataaaaaggttaagtagaaagttgagaattattattaatatccatacaaaacgtagatatattttcattcaagcgtaagataccaaaagaaaaaagtttttctactcgcagaatgctaaagtttgagcttgatcaagcttatcttttaaaatactcaaaaagaggtatattgttgttttaaataaattaaggcggtataaaaccgccttaattttgagtattattatcattagtattgactaataatattngctattcttttatctgatatttgatatttcgtacctaattgctgggcaaataaacttacgcgcaattcctcaatcatatagcgaatttctgctacttcatcggaaataggtttagattttggcagtttagcgagcaattgttggtaagcctgttgtacttgttccacgcgtagcatcgcagcacgatcacggtttacatcttgagccaacttatcaatacgtttatcaacggcttgcagataacgttgtaaatctggtaggcgatcataaccgctcttttgcacaaaaccttgatacaccaaacctgcaagttgcgatttgatgtcggataatgcaaatgccatcgtgaaatccattttgcctttaaggcgttggttaagttggtaagtgagagtaagaatctgctccactttctgcgcaatatccacggtcacttcgttaagattttctcgaacgaaatcacgcaatttttcaaagcctgcttcatcccaaacaaacccgccaaaatcggcaattagcttatctacggcacaagcgatacagtcatcgatcaaatccaatacgcgaccgaacggggtaaaatacagccccaatttggctttattcggcaatttttcatgaagatatttaattggtgatggcacattgagcagcaacagacgacgcaaaccttgctgcatcgccaccgattgctcaaactctgtttcaaacagtttgatacctacagcatctttttcatctacaatggcggggaacgctttgacgctgaaaccacgttgtttttgttcgtaacattgtggtaaatctgcaaaactccaaatatgcagcccactttgctcaatgccatcatctgccacagcagaaatactttcctgcacacgatcttttaagttgaatttcagctcatccaaattcatggattctgcgatttttttaccgttttcatccaccacacggaacgtcattttcagatggcttggaatttgttcccaattccaatgttccgcttctacggtgacgccagtcatacgacgcaattcataaatcagcgtatctaataatggcttttccaacggcaccgcacgacttaaaaaagcttgagcataattaggtgcaggcacgaagttacggcgataagatttcggcagcgatttaatcagcgcaatcaccaactcttcacgcaagcctggaatttgccagtcaaagccggtcatttccacttggttgagcaatggcaatggaatatgtactgtcacgccgtccgcatcggtacctggttcaaattgataagtcaatttgagttttaaattaccttgatgccagaaattcgggaaatccagcttgctcacttgttccgcatcatcattgatcaaaaatgaatgttcaaaattaagcaattcaggatcttttgctgcgcctttttccaccaggtatcaaaatgtttttgagagacaacttctgtgccaatacgctgatcgtaaaattcaaaaagcgtgcgatcatccaccaaaatatcgcggcggcggcttttgtgttccaattcttctacttctcgaacgagcctttgattttytttgaagaatttatgcttggtattccaacccccttccaccaaggcagattgaataaagatttcacggcttaccgttggatcaatagcaccgtaattactggtcgcacagccacaatcggcacgccgtaaagtgtgactttttcatctgcaatcacggcgccacgggatttagaccaaaggggttyggaataggatttttttattaaatgctcggcaagtggctcaatccattctggctcgatttctgccaccatgcgcccccaaagtttggaggtttccactaactctgccgccatcacccatttcggttgttttttgaaaagcacagaattggggaaaatcgcaaaatgggcattacgtgcgccaagatattgttgtttctccgcttcttttaaaccgatatgagaaagcaaaccacttaaaagtgcggtatgaatttgctgatattctgctttttcagaattaatcggcaagctcatttcacgcacggttaaacgaatttgatgataaatatcctgccattcacgaatgcgtaaataatttaagaaatctttttggcactgacgacggaattggtttttactcgattctttttgttgttcttgtagataacgccaaagattgaggaaagccaagaaatctgattttttatcggcaaaacgacgatgtttttcatcggaagcttgctgtttttcttgtggacgctcgcgcggatcttgaatggataacgcagagacgatgatcatcatttcataaacgcagccaaaattgaccgcacttaggatcattttggcaaggcgcggatcgactggaagttgagcgagttggcgaccaactctagttaataggcgtttttcacccgatttagtttgaacagtttcaaacgctcccaactcttccaacaacttcacgccatcttgaatgtgccgttcatctggcgcatccacaaaagggaacgcttcaatatcatccaaacccaatgccgtcatttgcaaaataacggaggctaaattggtgcgtagaatttcaggatcggtaaactctggacgagaattaaaatcctcttccgaatataaacgaatacaaatcccttcacttacacgaccacatcgacctttacgctgattagcagatgcctgtgaaataggttcaatcggtaaacgttgtactttggtgcgatagctataacgggaaatgcgcgcagtacctgggtcaatcacatacttaatgcttggtacggtcaatgaggtttctgcgacgttggtcgccaatacaatgcgatttaaaccgcttggatggaaaattttattctgttcttgtgcagacaagcgtgcaaagagcggtagaatttccgtgtgttttagattttgcttttgcaaggcttcggcagtatcacgaatttcacgctctccattcataaagatcaagatatcgcctcgaccttctgcttgcaattcatccaccgcattgagaatgccttgtagctgatcttgatcgtcttcttccactacgggacgataacgcacttcaacaggataggttctgcctgagacttcaataatcggcgcattgttaaagtgtttagaaaagcgttccacatcaatggttgcagaagtgataataagttttaaatcacgacgacgacgtggcaacaactgtttcagataaccgagaataaaatcgttatttaggctacgttcgtgggcttcatcgataatcaaacaagaatattgattgagaaaacgatcgttttgaatttctgctagcagaatcccgtcagtcatcaatttgatttgggtgttatcgctgatttgatcgttaaaacgaaccttataaccaactaaaccgccaagctccgtttccagttcttccgcaatacgcgccgccaccgaacgagcagcaatacggcgtggttgagtatgaccaatcatgcctaaattgccgaaacctaattccaaacacattttcggcaattgggtggttttacctgaaccagtttcccctgccaccacgatgacctgatgttcagaaatcagtttttgaatttcgactttgcgttggctaacgggcaaactctctggaaaaacaatcggattttgtaccgcacttttccgttgttctacacgtaatctagcttgttcaatttgctgctggatttcagcggcaacggcttgttgagcctcttggcttttaatttttccaataccatgaatgcgggcggataagcgacgttgatccaccagcatgatgtcatttaattgagaaaaaagagattgttgtaagggagttaatgtgtgttttaccgagctgtttttcatagcgatttacttttgaaacttccgtaagctaagctaatccatccgattaaaaataaagtsccgccaataggcgtaatccatacaattacattgcttgcttcgaaagcaagtgcgtataaacttccactaaataataagattccaattaaccaagaagacatagataatcgggcgaatttgttgtcacgtaaagcagataatgcaacggcaagtactgcaatggtatggaacatttgatattctaaccccgtatcaatccatgataatgctttggcttctaatatatggcttaagccatgagctgcaaatgcgcctagtgcgacacagaagaatccgcttaaagcaacaagagtaaggtatttgtttttcatttaaattttccctaaaagtaaagctaatatacctgcagcaataagtgggccaacgggaattccacctaaaaatgctacaccaataattgtgccgataagcaagccagtgactaaaatcggttgttcgcccattaaaggcacacctttgccggcaagccatgccacaagcacaccaacagaaatggaaagtgccattttccaactaagaaaacctgataaatcaggcaactgaattttccctgaaactaaggggcttaaaaccccaatggttaaaataatgataccaattttaacgccatatttttccaataaaggaatgtgagaagataaaaaagtttgctgcatgataagtaatacggcagcagaaatggtaattgtgctgttgttgcttaatacgccaagaataagaagtatcactagtaatagagcaatggtattgagttgtaatgtcataaagtgcggttaaaaaaatggaaattttggtaaatattctagcatagaaattcgtaaaattattttccattgttgttgagaaaaagataaatgagaaaagttaaaaagggttcattatgaacccttttatttagttggtaaaattcttaaatcatttattcctcaaatttaccttttttttctttattgatggtgcatttcgcgctagccaaattgcaaacaatacacccactacccaaatcgcatataacattctatttctccttagtataatgagtgtttatttttatcaatgaaattagcatctaaacgaccaaacatttttgagtaagaccaaatagtataagctaaagcaatgaccacaaaaacaactgcaaaaatcagcattaatgttaatgttaattcacttgaagtcgaatcccacattaataaactttgttcaggatgtgaacttgaaggcatcacaaatgggaacattgatactgctgcagtaataatcacaccagccattgttaatgcagagaagaaaaatgcaaaaccacaacgattagctttagaaaatgcagcatttaataatgcagcaactacagctaacgcagggaaaatccaaagaattggcatttcattgaaatttctaaaccacgcgccagtttctacagcaacttctttattcattggagacgatggagcgaaatgatcgatagtgctagtaactacataaccatctttagaatataaccatacgccagctaatacgaatgcaatcaaagtcacaatagaaccaatttgacttactgaacgagnacgatcacgtaaggcttcagtggttttcatttgtaaccagtttgcgccgtgagtgacaagcattgataagctaataacaccacataataatgcgaatggatttaatagctcaaaaaatgaacctgtataagtcacttgagttaattcgttaaaatggaatggaacgccttgtaataaattaccaaaagccacgccaaatactaatgctggtacaaaaccacctgcgaataatccccagtcccaaacagaacgccaagttggattatcaatttttgcacggtattcaaaacccaatggacgtaagantaacgctgccaagactaatactaatgcaatgtaaaaacctgagaaagatactgcatatacaattggccaagctgcaaatattgcaccacctgcagttaataaccaaacttggttaccatcccaatggggagcaatagtgttgatcataatacggcgttccacttcttttttacctattacaggtaaaagtgcggtcacgcccatatcaaatccatcagttacagagaagccaatcaataatacaataactaacacccaccaaataaaacgtagaaattcataatcaatcataatttatctcctacttatttagctgattgttcaaagtagtatttgccggtttttaacgcacttggacccaaacgcgcatatttaaacatcaaatacatctcaacaataatgaacgcaagataaagcgcacaaattaaaccaatagagaaccataaatcgcctgtacttaaattagaagcggatacgccaacaggtaagatctcgtaagtagcccaaggctgacgaccatattctgctaagaaccaaccacactcaatggcaatccaaggtaatggcaagccccataaaagaacttttaacaataatggaatttgagtgactttattacgtaaattttgaacaaatgcgccgaatgtaagtaaagcaattaaaccaccagctgcaatcattgcacgaaatgcccaaaaattagggcctacatttggaatagtatcacgagcggcttgtttaatttgttcttctgtcgcatcaacaacattgtttgtatagcgttttaataataaaccgaaaccaagatcttttttaacttcattgaattgtgctttggtttcttcatttacttgaccatttgcttttttctcagcgcgtagttgagtaaataattcataagcacggataccactacgtacacgagtttcatttaatgcttgaagatcttttagacctataatttctttatcaattgaacgagttgctattacaccgccaagataaggaatttcaatcgcaaaatcatttttcatttcagccgtatttggaattgctactggaaggaatggagcaggtgctgggtgagtttcaaattcagcttccattgcggctaattttactggttgtgctttaccaatatcataaccagattcatcaccaagaattagcactgaaatagaggcgataaatccaaaagtagcagctacggagaaagaacgttttgcaaattyaaaatcacgaccttttagtaaaaagtatgagctaatggctaaaacaaaaaatgcgcctgtcacataacctgcagaaagagtatgtaagaatttactttgtgcaacagggtttaaccaaagatctaagaagttagtcatttccatacgtacagtttcaaaattaaattctgaacctgttggtgcttgcatccagccatttgcaaccaaaatccacatagcagataaattagaaccgaaagccacacaataagttgctaataagtgttttccttttgataaacgatcccaaccgaagaaaaataaccccacaaaagtggattctaagaagaaggcaagtaacgcttcaatagcaagtggcgcaccaaaaatatcccccacgtaatgagaataataagaccagttagtaccaaattggaattccataataataccggtggtcaccccaagggcaaagttaataccaaataactttccccaaaattttgtcatatctttataaacttctttacctgtcgccacataaatagtttccataattacaagaataaaggataaacccaatgttagcggcacgaaaatgaagtgatacaacgcagttaaagcaaactgcaagcgagaaagatcaacaacgtctaacattctcaactcctttgtataaacaacattagttccaacaatgattaacaaggcgatgccttaaataatccctaattactcaactccaatcagctaagtttaaattgacttatctacataattatttttaaaggttaaaaaaacaccagttattatagagataatccaaattggcggctattctactactaaacataaggataaaaaatagtaaaaaatgctatatagatcacatttttgatataaatacaaaaatagggcttatttgttatattttatttaattgacttagatcaaattgacatttttgcaataatttttgttttaaagatgattaatttcattgtgtaagatcatattttaatatttgtctcaaccaacacatctcttgatgtttttaactgcttgaataagtatgtrgtggcatttaatacttaatttatcattcaacatttgtaatgtgattgtggatcctttccaaggataaaaaggattaagccaaaactagcattgagttcattgcgcaaatcaggtaaactaccatcccgtctttgatagctaattatcttcgatttttgaccgcacttttggttgattttgtctgtaggatgattagctataatcatttatattccaatacagattaggttccctatggctacaaattatatttncgtcactggcggtgtggtttcatcgttaggtaaaggcattgcggcagatcattggcggcaattttagaagcacgtggtttaaacgtaaccattatgaaattagatccatatattaatgtggatcccggtacgatgagcccaacccaacacggggaagttttcgttactcaagatggcgcagaaacagatttagatttaggtcattatgagcgtttcatccgcacgaaaatgaccaaacgtaataacttcactacaggtaaaatttattctgaagtattacgtaaagagcgtcgtggcgattatcttggtgcaacaattcaagtgattccacatatcactaatgaaattaaagatcgcgtcattgctggtgctcaaggtcacgacgttgtgattgttgaagtgggcggcactgttggggatattgaatcacttccattcttagaagcattacgtcaattagccgttcaagttggtcgtgaacatacgttatttatgcatttaaccttggtgccttacattccaacggcgggagaggtaaaaactaaaccaacccagcattcggtaaaagaattgctttctattggtattcaacctgatgtgttgatttgccgttcagatcgtatgattccaccaaatgaacgtgcgaaaattgctttattttgtaatgttgcagaacgtgcagtcatttcattaaaagatgtgaattcaatttatcaaatccccgcattattaaaatctcaaggtttagatgattttgtctgtgaacgtttccgtttaacttgccctgaagcagatcttactgaatgggaacaagtgctttacaagcaagccaatccagtgggagaagtaaccatcggtatggtaggtaaatacactgagttacccgatgcctataaatcagtaaatgaagccttaaaacacgcaggtttaacgaaccgtttaagtgtaaacattaaatatattgattctcaagatgttgaaaccaaaggtgttgaagtattaaagggcattgatggcattcttgttccagggggatttggttatcgtggtgtagagggtaaaattcgtaccgcacaatatgcacgagaaaacaaaattccttacttgggtatttgcttaggtatgcagatcgcattgattgaatatgcacgtaatgtagcgggtttaactaaagccaattcatctgaatttgataaagattgtgaacaacctgtggtggcattaatcacagaatggcaagatgcggagggtaatactgaagtgcgtaccgatgaatcagatcttggcggaacaatgcgtttaggcgcacaacaatgtcatttggtatcaggtagccgcgcccgcgagctttatggcaaagaaaccattgaagagcgtcatcgtcatcgctatgaagtgaacaataccttgcttccacaaattgaaaaagcaggattgaaagtaactggattatctgcagataaaaaattggtagaaattatcgaagtgccaaatcatccttggtttgtcgcttgtcaattccatccagaatttacttctacgcctcgtgatggtcatccgttgtttgcaggctttgtaaaagcagcctatgaaaatcacaaaaaatctgtgaagtaattcttggttctgcaataagtgcggtaaaaaaatgaaatatttttatttggttatgatataacttgatgtttttgaagtaaaaaaatccccgttaaatttatcatttaacggggnttttttataagctatttactgtttttatatttagttagtacgcttaactaatttcgtccagttataataaccatacaacgagttaagtaagtaggctgaatacattaagtatattgcaggtgtctctgcccataagaaaatagaaagaatatttaatccaatccataacaaccattgttcacgataacggcaaaatcattaaaatctgtgccgcaaccgtaataattgtagttagaccatctaaacctgttgagctaccaccagccgcttgtaatgcttgaacaaaaagcaaagtaccaaccgtagtcacaacaattaatgtcatccatcctttaacagttaacgcttttgcaatcacgctttctccaccatcgctattttgcatattggctttccacataaagtaaccaataaattgagagggnaaatatacgtaaagtacggtgttcatttcgcctaagaaattcgatccccaagcaacataaaaataagtataggcaaaaatcaatccaaagaaataattactaattttacctttacttaccaataccacacacaaaataccagaaataccagaaatcattgctaaccaagaatcaggtgtttgtacataagcccaaatttgcgcaatgataaaaagcgcaagccaaacccacctcaaaaggtttccaaccagaaacaaattcttgttttaaacgcgctgccaaagtcattatttactcctattgacttaaattttgaggtgaccattttcgcattgtgaattggtaatgtcaaggtgtagaagcatttaattctaaagttgtgaaatccatcacgttttaattaaagcctacattatctattattgagtttgtttcaaaaaacgctctaaaaattgaccgcactttaaatataataatcaagctcaagtggtatttttgcttgtaacaagaactgtttagtacgctcgtgttgtgggcaagtgaagaatttatctgctgtattttgttctacaatatgtccatccgccattaaaatcacacgatccgcgacatctttcgcaaactgcatttcgtgagtaacaataatcattgtccagccttcttgggcgagcatttttagtgtttgtaacacttcgcccaccaattcaggatctaatgccgatgtaggttcatctaataaaataatatcaggttttaccgcaagggctcgagcaatccccactcgctgttgctgaccgccagaaagttgggatggaaataaatccgctttatttttaagccctactttttctagcaaactaagtgctttttcacgagcttgagctttatcttgtttttgcacaacaaccattccctccataacattttcaagggcagaacgatgagggaataaattgtattgctgaaagaccattgacgaacgtcggcgtaacttcaattcatctgctttactaattttctggctaaaatcaatttttagactgccatcagtaaattccaaaatgccttgctctggtcgttcaagcaagtttaaacaacgtaaaaaggtggtttttccagaaccagaagggcctaaaattgcgaccacttcgcctttattaatttcaaaatcaatgccttttaacacatgattgccattaaagtttttctgaatattacttacttttaacatagacattccttataaatggcgagataagcgaatttcaagacgatcttgtaagaaagataaaacaaaacagaaaatccaataaatcaaagctgcctcactataaattaaaataaattcatagtttgctgccgtgatattctgtgcgacacggaataattctgtcactaaaacaagagaagctaatgaagtgtctttcactgtactaataaaagtattagaaagcgatggtactgaaatacgtaaagcctgtggcataattgtacgaataaatgcttgtcgataattcatacctatcgcataagaggcttcccactgccctttaggtatagcaataattgaagcacgaacagtttctgctgcataagcacctatattaatagaaaatgcaataatcgctgtcggaaaaggctctaaagtaataccgacttcaggtaacccataaaaaataataaaaatttgtactaacatcggtgtacctcgaattatagagatatacactcgacataaagcctgtaacaattttaagggtaaattaggactaggcaaagtacgaataactgcaacaatcactgcaataagcaaaccacagaagaaggaaatgactgccaatggcaatgtgtataaaattgctgcttccaacataggccaaaacgagctgattacatactcagctcgttctgcactcataaatggaagactcgccaaccaattattgagtaatatcataaccaaaccattcaattgaaatctgttttaatgtaccatcttggcgaagtgcttcaagtacttgattaaattttgtaatcaatgcatcttcaccttgtaaaaaagcaaaggcagtcggagttttatccccacgatcataagcaatttttaaaccagaatttgggtgttgtttaaaataatctaatacagccaatttatcattaattgttgcttctgcacggccttgtttaataagctctaagctctgtgctaaaccatccactacaagaatctgcgcacctgcagcttttgcatctttaccccagttacttgttgcagattgcgcagatttacgacctttcaagtcttcaaatgatttaatactgttatccgatgattttgttacaatcaccccaccagaataattataaggcgttgtgaaactgtatttttttaaacgctctgggcttgggttagtttggtttgcaatcacatcaaaacgttttgcatttaaccccgcatacattgcatcccattgtgtttctttaaattccactttcaaaccgagcttttcagcaactttacgaataacctctacatcaaagcctgttaattttccacttttatcatggaaagtaaatggtgcataagtcccttctgttccgactaataaagttttcgttttttcaacacgatcggcaatttcgcctgcgtgagaaaacgttgagaaagcaatagctccagttaaaagtgcggtcgtaaaaagtaattttttcattttttcttccttgtgttgtgtttgtctaagcgtgattataaaaaccaaacttatgaaaaaaaaagattatttatttatggtttatgaattttagttataaaaaattaatataagtgattactatcaaaataagaaaataatctaccgcactttcttgtagaaaaatacgtttctaaacaatgcaatcaatctactcttataaaatttcagtaaaaaaatgcctttctaaagaaaggcattaatagaaatttaagattataaataaacttgtaatgtctaatagaaaagcagcgtatctaattacgcttcatcacttccagaaaaacgttcaattttcgcacctaggccacgtaatttatcttcgatatgttcataaccacgatcgatatgataaatacgatctacaatggtttcacccgttgcgatacaacctgcaagcactaaactgattgaagcgcgtaaatctgtcgctattacctctgtgccagacaattgttcaaccccgtgacataccgctgtattcccttcaatttcagctttaccacccatacgaattaattcaggaatatgcataaaacgattttcaaaaatcgtttcagtgataatgcttgtaccttctgccaccatatttaataaagtaaattgagcctgcatatcagttgggaaccctggatgtggtgcagtacgaatattcactgctttagggcgattaccaagcatatctaaagtaatgctattttcagttacatcaacttgcgcaccagcttcacggagtttatcaattacggcatctaaagtatccgctttagtattttgacaaacaacacaaccgcccgaaattgctgcagcaattaagaatgtacccgtttcaatgcgatctggcacgacactgtgctcacaaccagttaaacgttcaacaccttcaatcgtgatgtgagcagatcctgcacctgttattttcgcacccattttattaaggaaatcggcggtatcaacaatttcaggctcacgagcggcgttttcaataacagtcgtacctttcgcaagggttgctgccatcataatagataaagtggcgcctacacttactttttctattacaatacgagttcccacaagacgatccgatacttgtgcttttacatatccttcttcaagaacaatatccgcacctaatttttctaaaccgctaatatggagatcaacaggtctagccccaatagaacaacctccaggtaatgatacttgaccttgatggaaacgagcgactaaaggtgccaatgcccaaattgaagctcgcatagttttaaccaattcataaggtgcagtgaaatgattgatattagaggcatctaataaaactgcaccagttgcatcacgatctacaaccacgcctaattgacgcaaaattttcaaagtagtttcaatatctttaagttcgggaacatttgtcaatttaacaggttctgtcgctaaaatagccgcaaaaagaattggaagtgcggcgttttttgcgcctgaaatattcacacttccacttaaacgagattgcccataaacacgaaatttatccatttttaaatccttaattaaactggtttaatgcacgatcgcgtttccatttttctacggtataagttttgatggttagagcgtgaatttcaccagtactaaaataaggcattaaaggggcataaatcgtttgttgttgttttacacgagatagtgcagcgatttcatcactcacaacaatcacaccaaaatgtgcattttcaccttgtgcatagacttctgcaatatttagtgtgtcttttaaaatttgttcaattttttgaagttccatcggatttccgtttagttaagctatataaaatttgcgatccaatcagataaaccaaagagatctgctagggttaataattgttttggtggataaactaatcgcactgttttattaagcttttgacactctcgtaaaaaatcacaaagagctgcaaaaccagcagaatcaatatgctgaagatcagacaaattccattcaacaatagttttatcaagtgtacttgctgacaaaaaaacgccacgttgctgccacattggtaacaacgtgctgcgagatagttccccaaacaaaaagagcgttattttatcattatttttttgcaaatcccaatttagcatagttattcatttattgattgaaaattataggttgtgaggcagattgctgcatctttgtgattaatgtatcaataccttgtttgtttaaaataccaacccaattttttatcgtatcttccagcatacttacgcctgctcccaccatatcataaactttccattccccacttttattgcctttacgccatttaaaatataacaagattggggcaactccgttagcttgaataatatttacgcgaatatttataaaattgttatcgcctaattctttttctgattcaatttgaattttttgattagaataatttgttaatgcttgtgcatacttttgctcaatcaattcgccaaaagttttgaaaaatttttcgcgttgttctgcagaggttgatttgtagtatgaacctaatactttagaacctgcatattctaagtttacataaggcaataaatcattacgaacaatagtacgtaaataatttggatcttgtttaattttactttgattagcttgtatatcagaaaatagtttatctgccgcttgctgcattaaaacataaggacttgtttctgcaatagctgttcgtgtaaccaaaaatgcggttaatacgaaagttaaaatggtaaaccatttttttagttgaataaggttcattatcaatctcctaatttataaaatttaacctattgttctgtggattctgatttttcattgccgtccgattttttacttccatataagaattgcccaattaaatcttccaataccatagctgatgtagtgtcttgaatctggctaccatttttaagcattgctgtatctccatcatcaaaacccattgtcaaggcaatatattgctcacctaataaacctgatgttttaattgataaagaactgttttctggaatttcattatattcttgattaatcgcgatgcttactttcggtaaatagcttttttcatcaagagtaatagcactcacacgtccaattactacgccaccgatttttagtggtgcacgtactttaagtccaccaatattatcgaaagttgccgtcacagtataagatttcgtctcagcaaaaccttgtacgttggctacgcgtaaacctaaaaaaactaaggcaccaataccaagtaataaaaataatccaacccaaaattcatatttaattgtttgtctcataaaaaaatccttaacctgcgccaaacataatagcagtcaaaataaaatctaatcctagaacaacaagcgatgcatgcacaactgttcgcgttgtagcttggctgataccttctgatgttggcatacaatcataaccattgaacagcgcaatccaagttacggctacagcaaagaaaaccgctttaataaagccatttaaaatatcataactccaactcacggaattttgcatcacagaccaaaaactgcctgaatcaacacctttccaatctacaccgactaaagaaccaccccaaataccaattgcgataaacaagattgataaaactggcatagaaatgacacccgcccaaaaacgaggtgcaatcactcgacgtaaaggatctaccgccatcatttcaagactagaaagttgttcagtggctttcattaagcctatttcagctgtcaatgcagaacctgctcgaccagcaaataaaagtgcggtaacaacagggcctaattctcgtaaaagagaaagtgctacaagctgccccaaacttgtttcagcagaaaaatcgattaacacgacataaccttgtagccctaataccattccaataaataaaccggacaacaaaataatgagtaacgattggacacctaaaacatgcatttgcttcacaagcaaaggaaaatgcttgcgaatttgtggcttgccgatcaatgcgccaaataacataaagcctgctcgccctaatgcacggaaaaagtcgatcacctgttttcctaaagcagaaataaaattgacgatcattcaaacaattccttcacataatcttgcgctgggtacttaaagcgcacaggaccatcagattcaccttttaagaattgcaccactcgcagatcttggctttgtaaaagctgctcagatgttccttctgcgatgactttttggtctgcaataatataggcataatctgcaatactcaatacttcctccacatcgtgcgacaccacgatagaagtcaaatttaacgcttcatttaatcgtttaatcaggctcaaaattacgcccatactgattggatcttgcccagtaaatggctcatcaaacataattaaatcagggtcaagtgcaatagcacgtgctaatgcagctcgacgagccatacctccggaaagttctgaaggcatcaatgcggcagcacctcgcaacccaactgcctccaatttcatcaacacaatttggcgaattaaattttcaggcaaatgcgtatgttcacgaattggaaaggcgacattatcaaaagtagaaatatctgtaaaaagcgcacctgattggaataacattcccatccgcttgcgtacttcgtacaattcacgattagatagacgacaaatatcttgcccatcaaacaaaatttcaccttgttctggcattagttgcccaccgatcaatttaagtaaggtggtttttccaatccccgacggccccataatcgcagtgatttttcccttttttacttgcaaattcaggttatcgtaaatcacgcgatcaccgcgtttaaaggtgagattcttaacttcaattaaattttgattcattaatatctcgtttataaataaaaagttcaatcagttttatatgacctgaaaaagttagatttgtttaatttaaagatgaagttttttcttttatcgcaacacatctctttggtttaactttgatgtggtcataaaaatagtgataaattttatttctattttttatagattaaaatttttgtaatagtaacattctttttgacctcactaaagaagctttacatttcttcattatttattgaattttaataatactttgtttatggaaaataaacattgataaatgcttataaataataagcctgtaaaagatacagatttgataaaaaagattgcaagagaaaagttatagagaggaaagttatagagaggaaagttatagagaggaaagtagaaaaacctagcttttgctaggcttttctatgtttattattttgcgcaattgctgtgtgctgttttttgttcaaaacgttctgcaacgaaatcccagtttaccacgttccagaattctttaatgtagtctggacgacggttttggaattttaagtagtaagcgtgttcccaaacatctaaacctaaaagtgggaaaccttcacaacctgccacttctttacccattaatgggttatcttggtttgctgttgatactacggctaatttaccttcagcagttaatactaaccacgcccaaccagaaccaaaacgagttgctgctgctttttcaaactctgctttaaatgcatctacagaaccgaaatcacgttcaatcgcatcttttaatgcgccttgtaaagtagtgccttttttcaagcttttccaaaataaactgtggtttgtgtggccaccagcattattacgtaatgctccacgtttttctgcaggaattttatcaaggttagaaattaaatgacccggatacatttctactaattcagcgggtaaaccttctaatgcagcatttgcattgtttacgtaagcttggtggtgtttactatgatggatttccattgtttgcgcatcaaaatgtggttctaacgcattgtaggcatagcctaattcagggagagtgtaagacataatgtattccttctattgttaaaaacagatttcgttgaggttttggtctataaccaaaattgagcaaataatagcaaaaaaattgatttagatcattaaatgtttttccttttttaaaaagtgaatttattaaattttgttttaaatcaataaacctatcgatctacttctaaagagttatgtgtttgagttgcgaaaatttcatcaaatattagaatactgtcactttctattttccctctgtaattatgtttgagcaacacaagttatctctgcaaaatttatcctgccaacgtggtgagcgcgtactttttcgtgctttgacttgcgattttaatagcggtgattttgtacaaattgaagggcataacggcataggtaaaacaagtttgttacgtattcttgcgggtttagtgcgacctttggaaggcgaagtgcggtgggattctgaagcgatttccaaacaacgtgaacaatatcatcagaatttgctttatttaggtcatctttctggtgttaaaccagaattaaccgcatgggaaaatttgcagttttatcaacgaattagtcaagctgaacaaaacaccgatatgttgtgggatttgcttgagaaagtgggattgctaggtcgtgaagatttgccggctgcacaactttctgctgggcaacaaaaacgtatcgcgttaggtcgcttatggctgtctcaagcgcccttatggattttagatgagccctttactgcgattgataaaaaaggcgtggaaattctaaccgcactttttgatgagcatgctcaacgaggtggtattgtgttgttaaccagccaccaagaagtgccaagttctcatctgcaaaaattgaatttagcggcttataaagcggaataacttaatgatttttttagagataattaaacgagaacttcaaattgcgatgcgtaaaaatgcggaaattttaaatccgctatggttctttttgcttgtgattactttgtttccgcttgttattgggccagatcctaaattactttcccgtatcgcaccgggtatcgcatgggtagctgcattactttcagcattgctttcttttgaacgtttattccgtgatgattttattgatggctctcttgaacaattaatgttaaccgcacagcctttgccaatgacagctttggctaaagtggttgcacattggttgctcactggtttgccgcttattttgctatcacctattgcggctttgttgctttctcttgaagtgaatatttggtgggcattagttttgacattgttactgggcacccctgtattgagctgtatcggtgctattggcgtggctttaacggtgggattgcgaaaaggtggcgtgttgttgagtttgcttgttgttccgttgtttattcctgttttaatttttgcttcatcggtattggaggcagcaggattaaatgtgccttatggggggcaactggcgattttaggtgccatgatggttggcgctgtaacgctttcgccttttgccatcgcggcagcgttgcgaattagtttagataattaattttattcatcgtataaaagtgcggtggtttttctctttaatttttaaggattttttatgtggaagtggctacatccttatgcaaaacccgaaactcaatatcgtatttgcggtaaattgagtccgctatttgcatttttaacgcttgtcttactcggtgttggcattgtatggggtttagcattcgccccagcagattaccaacaaggtaatagtttccgaattatgtatgtacatgcgccgacagcgatttggtcaatgggtgtgtacggttcaatggcgattgccgctgtggttgccctagtgtggcaaattaagcaagctcatctcgcaatgattgcaatggcaccaattggtgcattgtttactttcttatcgcttgttacgggcgcaatttgggggaaaccaatgtggggtacttggtgggtgtgggatgctcgtttaactgcagaattaattttattctttctttatcttggtatcttagccctttattctgctttttcagatcgtaacataggggcaaaagcggcggggattttatgtattacaacggtcgtgattttaccgattattcatttttcggtggaatggtggaacacgttacatcaaggtgcgagtatcactaaactggaaaaaccatccattgcaattccaatgttggttccattaattttgtgtatcttcggttttttaaccttgtatatttggcttactttagttcgttatcgcatggaattattgaaagaagatgcaaaacgtccctgggttaaagcattagctcaaacactgaaataaagtgcggttagtttttagcgattttttataaggaatattttatgtttttccaaacttggagtgatttttttaatatgggtggctacggtttttacgtatggttatcctatgcagtaagtttagtggcagttattgccttaattgttcaaagcgtcaagcaacgcaagacagtattacaaaatgtcttgcgtgagaaacaacgcgaagaacgtttacaacaagcaaataaggggaatacactatgaatccaagacgtaaatccagatttaaattagtcatttttgttgtgctcggcattgcaattgcaagtggattgatgctgtatgcgttacgtcaaaatattgacttgttttatacgccatctgaagtgatccaaggtaaggataataaccctaatcaaaaaccagaagtggggcagcgtattcgtgttggtggtatggtggttgaaggcacggtagtgcgtgatccaaaaagcttaaaagtgcggtttgatttaaatgatattggtcctgcgatcacggttgaatatgaaggcattttgccagatcttttccgtgaaggacaaggtattgtggctcaaggtgtattaactcagccaactgttttaactgcaacagaagtgttggctaaacacgatgagaattatgtgccgccagaattaggcgaaaaaatgcaaaaagtacataaaccaatgggaattgaggcagcggacttaaaaggcgaaagcgcgcgtgatcgtcaagaaaaagaaggcgcaaaatgattgctgaattaggaaattacgcacttgctttaagtttagctgtatcgcttatgttggcgattttccctttgtggggggcggaaaagggcaatgcacaattaatggcattagctcgcccaatgacttatggtttatttgcaagcctaagcattgcttttgctgcgctattttatttattcgcagtcaatgattttagcgtgcaatatattgtaaataattctaatactactttacccatttattatcgtttatctgcggtatggggttcccatgaaggctctttgttactgtggatttggttactggcggtttggtcatttgccgttgctttattgagtaaacatttaccccaagaagcggttgctcgcgtgcttggtattatggggattattagcgtcggttttgtattgttcgtcttgtttacctcaaatcctttcacgcgtactttccctgatttcccagtggatggaaaagaacttaacccaatgttgcaagatgtaggcttgattttccaccctccattactttatatgggctatgtgggtttttcggtggcatttgcgtttgcgatagcatccttaatgactggaaaattagattcagcttgggctcgttggtcacgtccttggacgcttgctgcttgggtgtttttaactttaggtatcgtactcggttcttggtgggcttattatgagcttggctgggggggctggtggttctgggatccagtagaaaactcatcgtttatgccgtggcttgctggtactgcattgattcactctctttctgtgacagaaaaacgtggttctttcaaagcttggacggtattacttgcgattttagccttttcactttgtctgctcggcacattcttagttcgttctggtatcttagtttcagttcacgcatttgcatcggatccaactcgtggtttgtatattttggcttacctcgttgtggtaattggcggttcgcttgctctctatgcgtataaaggcagtcaaattcgttctcgtgataatgcagaacgctattcacgtgaaagtatgttgttattaaataatatcttattaatgaccgcactttgcgttgtattcttaggaacgttgttaccacttgttcacaaacaacttggtttaggctctatttctattggtgcgccgttctttgatcaaatgttcttaattattatgacaccatttgcattattgcttggtattggacctttagtgaaatggcgtagagaccaattttctgcaattcgtacgcctgttgttatctgcgtatttgttatgctgattgcaggttttgcgttaccttatttcttgcaagataaaattaccgtgagttcagtgcttggttcaatgatgactgtgattattgcgttacttgcgctttatgaattgcaacaacgtgcgacgcatcgtgaatcattctttgttggcgtacgcaaactatctcgttctcattggggaatgatgttagctcacttaggcgtagcaatgactgtttgggggatcgcgtttagccaaaactttagcgtagaacgtgatgtgagaatgaaagttggcgagagcgcacaaattggtcgttacgattttaaattcactggtgtgacggatgaaaatggtccaaactatattggtggaaaagctcaaattgatatttctaaagatgggcaaccagaggcgagtttattcgcagaaaaacgtttttacacagtaagtcggatgtctatgacagaagccgctattgctggtggtttaactcgtgacctttatgtggcacttggcgaaaaacttgaggataattcttgggcgttacgcttatattacaagccatttattcgctggatttggattggcggcttatttatggcgttaggtggattgttgtgcatgttcgatcgacgctatcggtttaatgtgttgttgaagaaataattttattcttgccttcccctgcttgcgggggaaggtgcccgaagggcggaagggggattacgtatccccctcagtcacttcgcgacagctccccccataaatgggtggagcaaagttaatgaaaaagtgcggtaaaaaatgaaaaaaaaattactcgttcctcttattctctttttatcaataacaattgcctttttagtgcaattaaaacgcaatgcgcaaggtgaagatattaaagcattagagtcagctttggttggaaagcctgtgccagcaaaaaatttgacggagttgtttgaaaataaaacttacacgaatgaattgtttcaacaaggtgagccagttttgcttaacgtatgggcaacttggtgtccgacttgttatgccgaacatcaatatttaaacaaacttgctaaagagggtgtgagaattatcggtttagattataaagatgaatcacctaaagcaatgaagtggttaaaagatcttggcaatccttatcaagttgttttaaaagatgaaaaaggttctttcggtttggatttaggggtatatggtgcgccagaaacgttcattgtagatggaaaaggtgtgattcattatcgttatgctggagatgtaaacgaaaaagtttggactcagactttaaaaccaatttatgacaaactttcggagcaacaataatgaaaaaaacatggctatttttgaccgcacttttgtttagctcggtggcgttttcagctattgatgcattaaattttagttctccacagcaagagagtgattaccatcaattaacacaatctttgcgttgccctcaatgtcaaaataacaatattgcggattccaatgcgactatcgcagtggatatgcgtggcaaagtatttgagcttttacaagaaggcaaatcaaaaaatgacgtagtggattatatggtggctcgctatggcaattttgtaacctatgatcctcctataacagcgagtacattagtgctatggattgcgccattattgcttgtgttgttaggcgtggtgtttttattaagacgcaaacctaaaacccaaagtgcggtgaaatcccaagagattttaacggatgaagataatgcacgtttggcagaattattaaacaaggataaatagatgaattttacattaatttttatcttaaccactttagttgtggcgttaatttgtttttatcctttattatgtcaattcaaagcgaaacatgggcaaaaacgtgatgatttaaataaggcgttatatttctcgcgcttggaagaaattgagcaagataattcccaaggtttagttgaaaatgttgagcaacttaaacaagaattacagaaaaccttgcttgatgatgtgccgagcaaggttcaagagaatgtggattattctggcaaatcttatggaaaaatttggtttatctctggtgtattagcgttaggaattatcgcaggtccttcttattttatggtgggatcttggcaagccgaatcaatgttagagcaaacttatgcgaaattgccctatttctttgaccgaatgaaaaatgaagataaaaatccattttctgatacagaaatgcagcaattttctaccgcacttcgaatcgatttgcaaaaaaatccaactgatgccaaaaaatggtggatgctcggtcaaattgggatgaatttaggtgatgcacgtttggcattcgatagctatcaaaaggctaataaacttgaaccagataatgtgcaatataaattaggctatgcgcgtatattgatgttttctgaagatgcgactgataaacttaaaggtggcaatttattgcgtgaagtgattcgtcaagaacacactaacattgaagcattgagtttactcgcattccgttattttgaaacggaagattataaaatggcggcagtgacttgggcgatgatgctacgcttaatgccgaaagatgatgagcgtgttcctctaattgaaaaaagtattcgtaccgcgcgtgatgctttagaagcgcaaaatgaagaaaaatcaaaaagtatcactcccgaaaaataacctagtacgttataagactttttgatatagtgcgaaaaaattattcgtagtcgaacagattagcatttaataaagtactaaaggaacgagaaatgaataataaaaattgcacttttttctttgttctgcgtcattattggaagtttatttacttcacaattttcgattgcagaaaatgattctagtgcagtcacttatattgattctgaagataaaaaagcatttaattccgatgtttcaaataatgattctcaaaactagctcaaagtattgaatttaaagtttataaaatagatgaaaccacttcatcagaaagtatttatgaatctccagctggaatttgtcagggatttaagattacaaaaggtgtagattacacaaattcgacttaccattatctttatccagacaatagaggagaattctatggcagtgtggctggtgcactatttataaccaaaaagatcctcaaaatttaagttatgtgccagtttattcaattacagataaagatttatctaagcgtattcagttaaaagaaaataaaacattaaaggaaaaaacagcgaattatgtatcagaaggtagggctgtattaactgacgtaatttgtaaataggatgtatttaatgagaaaaatagtttttgttagttgtgtaattttaggtttagcagcatgttcatctcaaccagaacaaattggtggcggtgtttacgatatgaaaactgtgcaagaatataatgctcgagttattagtggtaatactgttacacaaactcaaaaggataaaataacgcaacaaattgatacaagtttaaaattaaaccaaagtgacaataaagttaaaacgagaacaagacgtgtattgcctgtccttcctgtcacaccaagcgtcggatatcattataattatcactattttagataaaaaattatcttgttatctgtgctaaaaattcttcttctgttagtactgtaatatttagttcttgagcttttgcaagtttagagcctgctgcatcacctgcgataacgaaatctgttttactggataccgaaccacttacttttgcaccaagctgttgtaataaggcttttgcttcattacgccccatttgtgtaagagtgcctgtcagtactacagttttatctttgaacaagttttcacttgcttctttcacttctacagtttcccaatgcacaccttgtgcgattaaatcctccacgactgcaacattatgcgcttcacgccaaaatataaaaattcggttcgctacaacttcccctacatcaggcacttgttgaagttcttcaagatttgcgtctttaagcgcatctaaagttttgaaatgattagcaagatttaatgcagtggcttcgcccacttcacgaatgcctaaagcaaaaataaagcgagcaagcgtcgtgctttttgcattttcaagactattgagagcgttttctgcagattttgcacccattctttctaagcgtgtgagcgtggttaaatcaagtttaaataagtccgcaggtgtatgaatcagttctcgatcgactaattgctctattaattttccgcctacaccatcaatatccattgctttacgagagacgaaatgttttaacgcctctttacgctgtgccgcacagaataatcctcccgtgcaacgtgctactgcttcgccttcaatacgaataatttgagaatcgcacacagggcaatttgttgggaaaatgattggtttagcattatcagggcgacgttcgtgtaatacgccaataatttgtggaattacatcgcctgctcgacgaataacaacagtatcgccaatagcgatatttaaacgttcaatttcatcgccattatgtaaggtggcattacttactgtaacgcctgcaacaaacactggctctaatttggcaactggtgtgattgcgccagttcgacccacttggaattcaacatcattcaacagggttaattcttcttgggcggggaatttataagcaatcgcccagcgaggtgctttagaaataaatcctagttcattttgtaaggctatatcattgatttttaataccgttccgtcaatatcataacctaacgagctacgtttgttttgaatatctcgataaaaacctaaaacttcatctgcaccattgcataaacgaatttcaggatttactggaatcccgatagattttagccattgcaaacgagcataatgcgtagtcggcagatcaaccccctcagcaattccaataccataagcatttaataccagcggacgtttgctggtaatattaggatcaagctggcgtaaagagcctgccgctgcattgcgaggattagcaaaggttttttcattatgttctaacgcatatttatttaaacgctcaaagcctgcgtgcggcataaaaacttcgccccgcacctctaaacgtgctggaggattatctgttaaaagttgcaatggaacattacgaatcgtgcggatattggctgtaatatcttcgcctgtggtgccatcaccacgagtggcggcttgtgtaagttcaccattaacatacaaaatactcacagccaagccatcaagtttaggttcgcaacagaaagtaagtggtttcggtaataggattaaacgatcttcaatgcgttttacaaaagcattaaattctgcatcggaaaaagcattatccaaagagagcataggaatttcgtgacgaatttggctaaacccagaaagtggttttgcaccaacacgttgagtgggcgaatctgacgtcagaaattcaggatgctctaattctagggctttgagctgatgaaataaacgatcgtattcgctatcaggcacactcggattatctaaaacgtggtattcgtattcatattggcgcaaggttttgcgtagattgtctagttgagtttgaatatttgtcataaaattctcggagaaaaatgaccgcacttttctatgtatttagcgtgaaaatagacaggtacacagcctgtctaaatgaatataaaagtgcggtaaatttaaggtatgaatttacacacgagcaagataggcttgctctgcatttgcatcaaaaatttcttgttcttcagtcagtataacaccttgtaaatcttcggctaatgtatgggcagcacgcatcatcatacgtaaattagcaagattattacctggagagggcaattgcataaataatacaattcctatggtgttaaattccgctaagttataagcattgaatgtgccgggttgttctaaattggccacactaaaaagcacaggacttgccacacttaaatctaagtgacgatgatacatttcatctttacccaagataaaacccaagttttcaagagcctgcaccaatttagcaccattaaattcttcgctagattttggaataagataaagttgaatatagccagttgtttgttttggatgagctgtcgtttctgcttttggttcattgaacgagaggttgtagtctacttgatgttcttcgtgagataattctgcaagctgcactcttaattctggcgatgatgaattaatgccattaaaaccaacattttgactttgtgcttcaagttgttctaaggtcatacttgcgacattatttgcggttggcatatcgtattgaggttgcgttggttgtattggctcggaacgatgattccccatatcataaataggttgcgtgttaggaatagaaattttgatgtcatccacacttttatcgctttggcgataatcgatcaattcagcttctgatggtaatttttctgtggtcggttgaggaattggtgtatgcccattttccacataggtatttggcgaaatattgtttggctgtaccatttcttcttgcgtatgggatctagatgttagagaagtgcggtcaaatttattggctttatcaaaatattttgatttctcacgacgatttgaccataatccgtgtacgattaaggcgacaagtgccacgatacccacaataatcaaaattgtatttaaatccatttttattccttacgcgcgatagttcggcgagagtgctataaatggtgctaatgctaccatatttcagtaggtgaaaaaatacttcaaagtgtggaattttaaaggaaaagtgcggtctgttttaagcatatttttattgaaaggaaagaaaaatgttgaatcttaatgaattaaaatctggtttccattattttgtgatgggttggcatttcatcacacaaaaaggtttgcgtcggtttgttattatgccaattgtgctcaatactgttttgctttgtggtttattttggctttttattagccaaatcagcagtgctattgattgggtgatgaattttattccagattggcttagttttctcagtgtcattttactgatactttcgattttaacgattttattgctcttttattttaccttcaccacaatttctggctttatcgcagccccctttaatggtttgttggcggaaaaagtagaaaaaatgctgacgggggaaaatattaatgatgatggtctcgtggatataatgagggatgtgcctcgtatgcttgctcgagagtggcaaaaattacgttatagcctacccaaaattatcgccttatttttactgagttttattcctttggttgggcaaaccatcgtgccagtacttactttcttgttcacttgttggatgatggcaattcaatattgtgattatccttttgataatcacaaagtctcttttgatatcatgaaaaatgtgcttggcaatcaacgaactcaaagtttaacttttggtggattggttacttgttgcacatttgtgccagtgattaatttattaattatgcctgttgcagtatgtggtgcgacgctgatgtgggtggaaaattatcgtaatgacttaggttttaatatgaataaatctttttcctctcaaacagggcttgatgttcgttcagaaaatacagggattgttaaatagcctacagttataaatagatcaaataactatttttttaatcaaaagtgcggtactataaataaaccaacattaacgaagtccaacgaaaggaaaatattatggcaatttatgcagacaattcttattctatcggaaatacgccgcttgtgcgtttaaaacactttggccataacggtaatgtggtggtaaaaattgaaggtcgtaacccaagctacagcgtaaaatgccgtattggggcgaatatggtgtggcaagcagaaaaagatggcacgctcacaaaagggaaagagattgtagatgcaacgagtggtaacacgggcattgctttggcttatgttgcggcggctagaggttataaaatcacgctcactatgccagaaacaatgagtcttgaaagaaaacgcttattgtgcggattgggtgtaaatttagtgcttaccgaaggcgcaaaaggaatgaaaggtgctattgcgaaagcagaagaaattgttgcttctgatccaagccgctatgtcatgcttaaacaatttgaaaatccagccaacccacaaattcatcgagaaacaacagggcctgaaatttggaaagatacggatggcaaagtcgatgttgttgttgctggcgtaggaacaggtggttcgattacgggcatttctcgcgcgattaaattagattttggtaaacaaatcacttctgttgccgttgagccagtggaatctccggtcattagtcaaactttagcgggtgaagaagtaaaaccaggcccacacaaaattcaaggtatcggtgcgggtttcattcccaaaaatttagatttatctattattgatcgcgtagaaactgttgatagtgataccgcacttgccacagctcgtcgcttaatggcggaagaaggaattcttgcaggtatttcatctggtgcagctgtcgcggctgcagatcgcttagctaaattaccagaatttgctgataaactcattgttgttattttgccttcagcgtctgaacgctacttaagcacagcactgtttgaagggattgagggataaataaaaaagaaaaaagtgcggtgaatttttaccgcacttttattaagactagagtagttcaatctgaatgacatcatattggtaagaattatagcgaactagattgcaaggttggttcgcaaattacagtaagaataaatttaggaactgtacaagataaccagaacaaacttcccttaactaattgttttaaaattgaaatttgagattttatttcactgttgttaaaacgtcattcacattcctttaaatgtagctcccaatgctctttgggaatacgtattaaacttgcgtaaatagcgttttgctttattccaaaaatgctcaattccgtttatgttcttgacgttggcaagcgtgaacacgctgaagtttacactgctgcaagcgatagattaaattaatctatattaatgatattagttgttattaatcacaaattaatttacatagcaccctatctttgataccagtgagaataaacaattatgactaaaccccagtaaaatcaaggcataagcgttaaaatttgttgttcttgctcactagcatcctaatttaatccccttattttatcctttccttcttattcaaaatcaattttttcttcttttcatattctgttcattgaatttttttattaatgcagtaaactagccaccgatttttaatcatctttcttttcactttaaatgttacccgcgagtaacaaaaggacacatcatgacaaacaaagtaaacagttatggctggaaagccttaattggctctgccgtcggctatggaatggacggtttcgatcttctcattttaggtttcatgcttagtgcaatttccgcagacttaaatctaacacccgcccaaggtggctctctcgtaacttggactctgattggtgccgtatttggcggcattttatttggtgcattaagcgataaatacggtcgtgtacgcgtactgacttggactattctnctttttgcggtgtttactggtttatgtgcgattgcacaaggttattgggatttactgatttatcgcacaattgctggcattggcttaggcggtgaatttggaattgggatggctctagcagcggaagcatggcccgcacgccacagagctaaagcagcatcttatgttgcattaggttggcaagtcggtgtgttaggtgcagcattgcttacaccattattgctcccacatattggctggcgtggaatgttcttagtgggtatcttccctgcatttgtcgcttggttcttacgttctcatctgcacgaacctgaaattttcacgcaaaaacaaaccgcactttcaacgcaatccagctttactgataaattacgttcatttcagcttctgattaaagacaaagccacgagcaaaattagccttggtatcgtcgtactcacttctgtacaaaacttcggttattacggcattatgatttggttacctaatttcttatcaaaacaacttggattcagtttaactaaatctgggctttggacagccgttaccgtctgcggcatgatggctggaatttggattttcggacaactcgccgaccgcatcggacgcaaaccaagtttcttacttttccaattaggcgcagtgataagtattgtggtttactcacaacttaccgatcctgacatcatgcttcttgctggggcatttttaggtatgtttgtgaacggaatgctgggcggttacggtgcattgatggcggaagcctacccaacagaagctcgagcaacggcacaaaacgtacttttcaatattggtcgtgccgtagggggatttggacctgtagttgtgggctcagttgtacttgcttactctttccaaactgccatcgctctacttgcgattatctacgtaattgatatgttagcgacaattttcttaatccctgaattaaaaggtaaagccttagactaagaaaatataaaagataaaaatgttcgccaagtgcgagcattttttatgaaacaagtcatcttataagtaatatctttataagttttcttttcactaagcaaactttcattattttgccaacagttcgttcaatttttctaatgccatttctggcgtaatatcaatcaaactttgatgatacccaccctctttgtcgcctttacggactttaattaattcaccttcaattaaacgaataatcgttgctttatctgaaagcggcggcgtatattgtgggctagttggtccataaagtgcaatcaatggacgatttactgctgccgcaatatgcattaaaccactgtcattggtcacgactgccgtacaatttgcaattaaatccaccgcttcattcaagttggtttttcctgctaaattgacacaaaactcacgcaactcttctggcagcgcttgacgaatttcttcgcccacaggttcatctttagcagaaccaaatagcgccacagcatagccttgggtaattaacatttctgctaattttgcataatgataatgtggccaacgttttgctgggccaaattccgcaccaggacaaaaaccaataattggacgctcgcctaaaagtgcggtttgtttttcaaatttttttaaggtttcagcttgttgcgctggctcaaccgtcaaatagggtttcaagacaggaatatcatcagcttttggtataacatctttttcaaaagctaatgcaacataacgctgcaccatcattggataatcttttttattggctcgtaaatcattcaataaaatataacggctttcgcctttccaaccgcgacgatggacaatttttgcgaagaaaggaataaacgccgatttcaatgaattaggcaaaacaattgccatatcatattgttcacgcaaagactttcctaaacgataacgcgttcccaattcaaaggccccgtgccctaatggcatttcaatcgccttacgcacctctggcattcgcgcaagcaaaggcttacaccaattcggtgccatcacatcaatattgcagtttggatattgaattttcagttgctggtacaagctgtgcgacatcatcatatcgccaacccaagatgggccaataattagaatattcattttctgtctttcagataaaagtgcggtcaaaaatacttgttattatggcacagagttgaataaaaatatgctcctttaacaatttagtcgaaactctttaggagtcatttcaaattctttcttaaaaacagaataaaaatattgaattgatggatagccgcaaatctcagtaatttctttaatagaaatatctgtttgttgtaataaattctttgctcgggaaattttttcttcgtggatgacttggtgaattgttttattcatttcattcttaaaacgttgttcaagattagaacgtgaggtttcaagatgatctaaaacttgtcctactttaattcgatgacaggcacgatgacgaatataatgcattgcttgaatgacaagcggatctgttaatgatcgataatctgtagaatttcgagagtgaacggtaatcggtggaattaaaataggggtatgtgaaactttttgaccattgagtaatttgtgtaataatttcgcagcttgataaccaatctctctcgtgccttgttctacggaggaaagggacatacgcgataaatattggatcaattcttcattatcaataccaaccacacaaagctcttcaggtacagcaattttactgtactcacaagcctgcaataaatgacgagcacgcgcatccgtaacagcaataataccagtatgagaaggaagagattttaaccagacaattagcttttgttgctcttccaaccaattttgagcatgaacctgcacaccctcatataggtaaatagggtaatgatttttctccatcaactctacaaaagcatctcttcgttctatagaccaatgcttatgagtatttacttgcaaaccataaaatgcaaactgtgacagtcctttctcctgtaaatgagataaagccatttcaaccaatgccatattatctgttgctatataaggaaagtgcggataaaaatcagcttgtttataagatccaccaactgctatagtaggaataagagtgtgttgcaataattcaacagtttttggatcatcaaagtctgcaataatgccatcaatagaaagttgattaatggtatcagtatgatagataaattcatcttctacaaaaatatcccacatacattgcgatgcctgaatatattgtccaataccctccaccacctgccgatcatatactttgtttgcattaaataagagggcaattttgtagtattgttccgtcattttatatccttatctatgggaaattgctatttaagttataatagaaaagatatttagcttcaagataaaaatagccagaataactggccatttttatatccaataccacatttatttttttagcttcgcaatacctattccacttgcaccataaataatagcaaagataataccgctccaacataaaattgcccaaggtaaataagacaatgttgcaacacctaatgtgcctgccatatatgcacctgcggcagtccatggcaaaataggttcaataattgttgcggagtcttctgctgttcgacttagattttttggatgtaatcctttttctacatacgcatttttaagcatttctcctggaattagaatagaaatttgcccattacaagtaaccccaatcattgttagaccgcaaagaatcgttgtaataatcaaagaaagagttgaatgaacaaaggtgagtaatttttgaataatcacggttaatgcaccgctcaattgtaatacacctgcaaatgacaatgcacagaaacaaattaatagtgttcccatcattgagttcattccaccacgattcaacaaacgacttaaatcagagctaactgaagtatggtgaatcattgaggtatcaaatccattaactgcactattaatcacatcagatagagagaatttttgaattaagatagcattaataattgcgataaatgctgataataacatcactggaatagtcggtttcttagtaatagatccccataatacaatagcgactggaataagtaatagaaagttaaaatgataaacttgctctaactcatgaatcattgtatttactttttctggagtcgctacattagaaaaatcgtagtttaaaccatataccacatagacagtagccgaaagaataaaagatggtaatgttgtataaagtaagtgagcgatatgctcatataaatctacgccagcagctgcggatgcaatattggttgtatcagataatggcgataatttatctccaaaatacgcaccagcgaccacagcacctgccgtagcagccaaattggcgtctaatccaatcgcaactcccataaatgccacaccaacagtccctgctgacccccaagaggttccagtacaaatggaaacaatagcagtaaggaataaggctgtcacataaagatattctggtgatatcgcttttagtccgtagtagatcatcataggaattgttcctccactaatccaagttccaattaataatcctacagtaattaaaattaatagcgcaggcattgttttagctattttttctgaaatggcatctaaaatatctaaatagcaatgacctaatttaaaaactaaaaaaccagcaaataccgttgaaataatcattaatggctctgctggcaaatcaaataaagcatacccaagccctaacagtaatagcatcacaatgattggtgaaaaagcttctaatgttgttggcattcttgtgcgatgagtggttttcatattaaatctccctattgtttaataaacaaaacccatttttgattcgattcaatgcttctaataatttttttctaggcatagcgacattcatacgaaagaaaccatctccctctttgccaaattcactccccaaagatacttttactcttgataaattattaatccaataagctaattcattttcatttatacttagctttttatagtttatccaaagtaaataagttccatcactttcagtaatatctaataatggaatatactcattgaaaaattcttttactatcttcttattattctttatgtattcttttagatagattacccaatcagtacaatatttatataacgaaataatagctggtatagagaaataatttggattatgtatacctaatgccatcatttattttataaattgttctcgaatttctttattctcaataattaggttagctatttccaatccaggaatattaaaagtttttgctggggataaacagatcattgagtgatttgctacccattcatctaatgatgatattaaatagtgggagtcatttgttagtgtaaagtctgcgtggacatcatcggaaatgataaatatattatgttttttagctaagtttataattttaataaggacttctttattccaaatcgttccagttggattatgaggagaaattaaaacaaatactttagaatgtttaaaacattcctctaataaatgaaaatcaatatgatactttctattttcataaaccaaaggacattgatataattttctgtcatttaattttatcgtgtttaatattggactatatgaaggtgatagaatacatattccatcagtttcttttgtaaatgctcgtatataaatagatacggcttggattattcttgggcaaaatacaattttttcagagagaacagaataatgatattgttcgaaaatataatcactgattatcttgtaatagtcggctggtaattcagtataaccataaattcctaaacgattaaatttttctaattcatctatcattatctgaggggctggaatatccatatccgcaacagacattggaataatatcattatctacattccatttagcactaaatgtatttaggcgatcaataatcacatcaaaattataaaaattattcattattcctcctgatgtataaggcaaatttactttagtcaaagaagaaaagaattaaaattactaaaactactttatctattacgttttttcacaactgtgatctagtccacaattgtaaataatcactataaaaaattaaataatgtaacggataagaacttgtttttttataaaaagatgaaaaatttcatcatctagaaagcagtatgttaggtaaccatttctataaaattaaaaaaccgccattttataaatgacggtttaaaattaataattacatctttttcttattactagtatctatccatacagcaagtaacaaaatgccacctttgacaatatattgccaaaaagttggcacatcaagcatactcataccattatcaagcgatgcgatgataagtgcgccaataacgaccccaaacacacttcctacaccaccagctaagcttgcccctccaatgacacaagctgcaatcgcatctagttctgcattttgcccagcagatggtgatcctgcacctaaacgagcacttaaaatcaaccctgctattgcaactaacacaccattcattgcaaagataatcagttttgttttctctacattgataccagataattttgccgcatcaatattgccaccaattgcataaacgtggcggccgaatgaagttttacgagagaggaataaccctaagattgcaagaactgccagtactaaaacaggaaatggaatgccacgataatcattaagtaaataaattgctcctaatacaattactgcaaacaaagcatatttcgtaaaatcttttgataatgcagacacttccagctgaagctgctggcgacttctacgttgataatttccccaaagaacaaatccaataactgcaataccacctaagataacccctgcaatatctgataaataaccttgcccaataactgtcatagttccactaataggagatacagttgtaccattagtcaaaccaatcaaaattccacgaaatgcgagataacctgcaagtgtaacaatgaaggatggcactttgcgataagccacccaccaaccattccaaataccaaaaattaaaccaagagcaattgttgcaataatagttacaggtaatgggaagccccaccaaacatcggcaatagctgcaaatccgcccagtaggcccataagtgaaccaacagataagtcaatttcagcagaaataatgacaaaaaccattccaattgcaagawtgccagtaattgargtttggcgtaacaagttagaaatatttcttgcacttaaataagcgccatcagtagcaacactaaagaatgccataatgactgcaatagctattaacataatgtaaacttgtaaatttacggattttaacttaaacatagattactccttaagtgctgtttccataacttgttcttgagtaagagcagtattgataagactagctttaagtttaccttggtgcataacaagaactctatcactaatgcctaaaacttctggtagttctgatgaaatgacaataatagcaatcccttcttgtgctaattggttaattaacttataaatttcatatttcgcaccaacatcaattcctcttgttggttcatctaaaatcagtattttaggatttaacgataaacattttgctaggatcgctttctgttgattaccgccactaagtcgtcctattggcaaatctggtgaaaaagttttcacctttagtcgtttgatggctgagccaattatttgctcttcttttgcttcattaactaccatttttccgaaacaataagatttcaaagaagaaagcgtaatgtttttgccaactcccataatagaaacaatgccgtgtttcttccgatcttcaggaaccatcacaattttatgttcaatcgcttgggcacaatttttgatatttacttgtttttgattgataaaaatatttccttcaaacttaccttcataagacccaaataagcattgcaccatgtctgtacgacctgaaccaactaaacctgcaacacctaaaatttccccctcatgaagactaaaacttacgttatcaacacgcttaatatgtgtattgattggatgccaagcagagagattttctactcgtaaaatttcatctttgatttcatgaggttcatgtggataaagtgaggtaatttcccgacctaccatcatggtgataatgtcatcttctgtcattgttgaagcgtctttcgtaccaacatgttcaccatcacgaatgacgcaaattttgtcagagatagccttaacttcattgagtttatgggaaatatagatacaagcgatattgtgtgctttaagatccttaataagatttaacaaaatttccgtttctttttcagtaagtgaagccgttggttcatctaagataagaagtcttacttgtttattcaaagccttagctatttcaactaattgctgttgccctaaacctaattctcctactcgtgtattgggatcggcatctaattgcacctgctgtaataaatttttgcaacgtaagtacatttcattatctgctgtcaaacctttatgagttatttcgttacccaaaaaaatattctccaatacagacatattctttacgagagtaagttcttgatgaataattgaaatgcctttttcttcagtatctctaatattccttgcttttagttcactttctgaaaagtaaatatcaccgctgtaatctccacaaggataaataccgcaaagtattttcattaatgtagattttccagatccattttcaccacataaagataaaatttcccccgcttctaattcaatggatatattatgaagtgcggtcacatcaccaaatttttttgtgatatgtttcatttccaacaatgccatatcgtaactccctaagaggtaagggaagagttttctcttccctcttaaagttagtgataaatactttccttagtatgaaaaccatctttaattacagtttcattaatattacgtttatcaacagcgataggatcaagtaaatacgcaggaacattttttaagccattattcagttctgcattagcttctattttttcattcttacctaattcaaccgcaatttctgccgctttatctgcaagtttcgtaattggtttataaacagtcatagtttgcgagccattgacaatacgtttaattgcagctaaatctgcatcttgcccagaaattgcgactttcccagataagccttgtgcgctaagggcttgaatcgcacctccagcagtagcatcgttagatgcaacaacagcatccacattatttttattagctgttaatgcgttttccataatttgtaacgctttttcagctaaccaagaatcaacccattgatctcctacaaccttaattttcccactggcaattaaaggatctaatactttcatttgcccttttctaaataatttcgcattattatctacaggagatccccccattaaaaaataattaccttctggttttacagccacaatacttttagcttgtagttcacccactttttcattatcaaaggaaacataaaaatctaaatctgcattattgattaaacggtcatacgctaatacttttattccttcctttttagcttcagaaataacgttacttaatacttcaccgttatgaggaataattactaatacatcaatatttttattgatcatattttcgatttgagaaatttgtgctgaatcatcaccatttgcagattggacaaacacttttgcacccattgattctgctttgtttacgaaaatatctcgatctttttgccatctttctaaacgtaaatcatcaatggataaaccaattttaagatctttggaatgggcagaactactaaatacagttaatgcaccaacaagggtaagtaaagctgatttgattttcatattgatacctcaatagttaagtgaaggactagttattgctccagttgttagttttcacactttaaaaaaggctttcaattataaaatctttctccattattacgttttttcacaactgtgatccacgccacagttgcaaataatcaacatagaaaaattaaataacataattgatgaaaagttagtttttcacaaaaatacgaaaaatttcatcacctagagaggaaaatgttatgacaacctatttcgataaaattgaaaaaatctcctttgagggagaaaaatccacaaatccttttgctttcaaacattatgatgctaatcaagtaattttaggtaaaactatggctgaacatttacgcttagcggtgtgttattggcataccttttgctggaatgggaatgatatgtttgggctaggttctttggaacgaagttggcagaaaaattcaaatttgcttgctggcgcagaacaaaaagccgatattgcttttgagtttttgaataagttaggcgtgccttattattgttttcatgatgtcgatattgcacctgaaggtaattcagtgcgggaatatgtacaaaattttcatcatattgttgatattttagaacgcaaacaagtagaaacgggtgtaaaactcttatggggaactgcaaattgttttactaatcctcgttatatgtctggtgcagcaaccaatcctaatcctgaggtttttgcttgggctgcaacacaagtgtttaatgcgatgaatgccactcaacgtttaggtggagaaaattacgtattatggggtggacgtgagggatatgaaactttattgaataccgatttgaaacgtgaacgtgaacaaattggtcgttttatgcaaatggtggtagaacataagcataaaattgggtttaaaggtacattattaattgagccaaaaccgcaagaaccaactaaacatcaatatgattatgatgtggcaacagtgtatggtttcctaaaacaatttggtttagaaaaagaaattaaagttaatattgaagctaaccacgcgacgcttgctggccatacctttcaacatgaaattgcaacagcttgtgcattagatatttttggctcaattgatgctaatcgtggcgatccacaattaggctgggataccgaccaattcccaaatagtgttgaagaaaacacgttagttatgtatgaaattttaaaacatggtggttttactactggaggttttaattttgatgcgaaaattcgccgacaaagtattgatccttatgatttattttacgctcatatcggtgcaattgatgtattggcattatccttaaaacgtgcagcaaaaatgttacaagaggaaaccttacaaaaaattgttaatgaacgctatgcaggttggaatagtgaacttggtcagcatattttgcaaggcaaaacttcacttgaaacacttgcgcaacttgtccaacaaaaagatttagcaccaaaaccagtttcaggtcagcaagaatatttggaaaatttggtaaaccaagttatttatagctaaaaatgaagcaaaagtgcggttgtattccaccgcacttttttattttaggagacattatgtatataggaattgattgtggcacacaaggaacaaaggcgatagtgcttgattctgtccaaaaaaaagtgattggagttggttacgcaaaacatgaattaattacacaatccaatggaagacgtgaacaacaaccaaattggtggattgaggcattacaacaagcattacaaattgcattgaaacaagcaaaaaattcaccgcacttttcacctaatttagtgaagggaataggcatttcaggacaacaacatggactggtaatgttagataaaaacgatcgtcctctatataaggctaagctttggtgtgatacagaaaccgctacggaaaatgatatactgatcgaaaaattaggcggacaaacagccgtatttgaaaaattaggcatcatttgccaaactggttacacagcttcaaaactaagttggtttcgtcaaaattatcctgacaaatttgccaatattcgcaaaatcatgctgccacacgattatctaaattattggctaacaggaaaattctgcactgaatttggtgatgcttctggtagtggttatttcgatgttgtgaaaagagaatggaaaagagaagtcttcaaatatcttgctccagaattaaatatggatgaagtgttaccaaaattactttctgctgaacaaaaaatcggtgtgattaaacctgaaattgcgactttatttggttttaatgagaatgtcatcgtctccacaggtggaggcgataatatgatgggagcaattggtacaggaaatattcgagaagggattgctacgatgagtctcggtacttctggtaccttgtatgcttatacgcaaaagccattacttaatttaccaccaatgatcgcaaatttttgttcaagtaataatggctggttaccactggtttgtgtaatgaatataacctcctcaaataaacagctaatgaatttgctcaatattgatattgaagaattaaatcaacttgctcaacaagcacctattggcgcgaatggcatcactattttgccattctttaatggtgaaagagttccacctttacccaatacaaaagcgagcattttaggattagattcaagtaatttcacacgagaaaatctttgtcgagcaatgatggaaagtgctacttttacgcttcgctatggcttagatttatttcgtcaagctggcctcaaaacctcacaaattcgcctaattggaggtggcgcgaaaagctcattttggcggcaaatgattgctgatgtgatgaattctgaagtggtatgtttgcaggaagaagaagctgctgcattaggaggagcaattcaagctatgtgggcaaatggagaaggagaactggaatttttatgcgaaaccttcattcacttagatgaaaactcaaaagcttatcccaacttatcacaggtgaaaaattatcaaaatgcttatgagcgttatttaacacatttatcacaattatattaaataaaatcccctataccgataagctataggggatttactacattaataatttattttctattcaaccacgccatatattcagtcacgccttccgcaactgttttgaatggtttatcgtagcctgttgagcgaagtttagttaaatctgcttgagtatattcttgataacgagatttcaaatgctctgggaatggaatggtttcaatctcgccttttccgtggaatttcactaccgcatcagccaccgcacggaaactttctgcatttcctgtaccaaggttgtaaatacccgaaataccattttgccaacaccaaatattcactgctgccacatcacccacataaacaaaatcacggcggaagtgttcgctgcctgcaaataattttggattttcgccttttaagatttggttattcaagtggaatgccacactcgccattgaacctttatgattttcacgcggcccgtaaacattgaaataacggaaaccacatactggcgattttgcttctggcaaaatgttacgcacatattgatcgaacaagaatttagaatagccatacacatttaatgggccttcaaattcacgttcttcacggaatactttggtatctccataagttgctgcgcttgaggcatagraaaaaggaatttcgcggtcaaggcaataatgcaacaactctttagaatattcgtagttgttgtgcataatgtatttgccatcccattccgtagtcgcagaacaagccccctcgtggaataccgcatcaatatcgccaaattcatcgcccgcgataatagaagcaatgaaatcttctttatcacaataatctgcgatgtctaaatcaactaaatttgcaaatttcgtgccatcttttaagttatcgaccactaaaatatctttgcgtcctaaatcattcaatgctttgacaatattgctgccaataaaaccagcgccacctgttacgataatcataattctgtcctctttaaaataagtctgcgtattgtaatagattttctaccgcttagccaaaaaactctgcgaaaaacaaccgcacttttaatccccaataactcgtaaggccggtcgtaacaagatccattttgcctttactcaacaacacaattgtgggtgtcacattaatttgccatcgttctgcaaattcccctttaggatcattaaccgtagtgaagtggtagtcatttttacttaaataatcatttacgtctgcctcattacctgaacgtaatgccaccgatacaacttgatacccttcttttgctaaagaattaattgctggcgaagtataacgacaataaccacaccaagttccccaaaaataaagtaatgtgggtttgttttgatcaagactttcaagagagaacgtattcccttgaagatcttgtaacgtgattttatttatttcctctggcactacagggcgacgaacaaaatccagtatgctagttatcacaataaaagttaaaaagagggataatccattcttgagtaattttttaatcttcattttatttattccttatcttgttgagatgattgtaattgagcgtaaaaccatagtcaaaaataaagaatttttgctacaataggtaaaacataaataaaaggaggaaaataatgacatcaaatcaacttgctcaatatatcgatcacaccgcacttaccgcagaaaaaaatgaacaagatatttcgacactctgtaatgaagcgattgaacacggattttattctgtatgtatcaattctgcttatattccactcgctaaagaaaaacttgctggctcaaatgtaaaaatttgcaccgtagttggattccctttgggggcgaatttaacctcagtcaaagcatttgaaacgcaagaatctattaaagcgggtgcaaatgaaattgatatggtgattaatgtaggttggataaaatcgcaaaaatgggatgaagtaaaacaagatattcaagcggtatttaatgcttgtaatggcacgccattaaaagtgattttagaaacttgtttgctcactaaagatgaaatagtgaaagcctgcgaaatttgtaaagaaatcggtgtagcttttgttaaaacatcaacaggctttaataaaggtggtgcgaccgtagaagatgttgcattgatgaaaaacacggtcggcaatattggtgttaaagcatcaggtggtgtgcgtgatactgaaactgcacttgcaatgattaaggcgggtgcsactcgcattggtgcaagcgctggcattgcgattattagcggtactcaagacactcaaagcacttactaatcctttcacgcgtggtattctttccacgcgtttttacatattcgacaatttctgcagcaaacgaaccattgctcgatagcccaaggcctccgccaagtgcggttgaaaaatttgttgttctccttgtagatcggcaatggttcgagaaactttcaaaatacgatgataagcccgaacagaaagccccagtttattcagtgctttttcaaggaaaaaggcatctttatcatttaacttgcaatcacgctcaatctctttactgttcaaataagcgttgattttccccgctctttccatttgaatctcacgtacttttaacactttttcacgaacttgcgcgctggtttcgccacgatcgcccgtattttgcaagctaccttgtggcagtaaaggcacttcaatagataaatcaaaacgatctaaaaatggccctgaaagtcgattcaaataacgcataatttgctgtggtgaagtgcggttatgtgttcctgtataatggcctgtcggacttggattcattgctgccactaattgaaaacgagccggaaattgaattttggcattagcacgagaaataataatctcaccactttccaaaggctgacgtagtgcatctaacacttttcgctcaaattctggaagttcatcaagaaaaagtaccccatttgttgctaaggatatttcgccaggtttagggatcgttccgccaccaactaaagcaggcattgatgcactatgatgtggtgcacgaaaaggacgttgcttccaattatgaaaatttaactcgttttgaactaaactcgttacagatgccgtttctatcgcttctaaatctgtcatttcaggtaaaagccctgtcaaacggctggctaacatggttttccctgtacccggtgggccaagaaagagcaaattatgctgccccgctgcggcaatggtcaatgctcgtttagcgtgctgttgtccgataatatccgttaaatctaacgtatttttacctgaaaaatttaccgcactttctttcacaatttcagtggcgagtggtaatttttcctgaccattgagaaattgcactacatctaaaagcgtttgagcaaaataagtattttgatcagacacgagcgaggcttcattagcattttgtttcgcaataattaactctcgctttgacttttgcgctgcaagaatagcgggaatcacaccatgtacgccacgcaattggcccgtcagcgcaagctctgccacaaattcaaattgctttaagtggctcgcatcaagctgatctgatgcggctaaaattccgatggcgataggcaaatcaaatcttccgccttctttcggtaaatccgcagtgcaagatttacagtgatacgcttggctgggtatttaaattgtgcattcatcaacgcactacgcaccctatcttgtgcctctttcacggttttttctggcaaaccaacaagtgtaaatcctggttttccgttgcttaaatgcacctcaatggtgacaagcggcgcttgcacgcccatagaggcacggctgtaaacaatagcaagggacatgataatccttaaagtgcggtaaaaatgaagatagtttttgcactataaaaaaagcacgtaatgaaatcattcattccgtgctttttttgcgatctagatcgcaaaattcatattttwattccgcaaaaagtggcgaaaaccaaaaatctaatttcaccgccaatttatcaataccaattttattttgtgcagaaaaagcctcaacttgtatatcgccttgaaatggaagaattgcttcacgcaccatttttacttgtttactacgtgcgctttggctcaatttatcggctttagtaagcaataaaagtaccggtaaatttgctgaaaccgcccattcaatcatttgttggtcaagatccttaagcggatggcgaatatccatcaacacaaccaatcctgccaaacattctcgtttttgcaaatattcgcccaaggatttttgccattggattttcatttgctctggcacggcggcatagccatagcctggtaaatccaccaatttacaattaggctctacttcaaataagttaatcaattgcgtgcgccccggtgtttttgaggtgcgcgctaaatttttttgattggttagtgcattaagtgcggtcgattttcctgcatttgaacgacccgcaaacgcaatttcaatgcccgtatcttcaggaatggaacgaatattcggcgcgctcgttaaaaagtgggttttgtggtaattaagtttaatttcagacataagtattccttttaaaaattgtgtttagaatagcataaatggaaaatttcctgaaattatgtcaaaattctctctgaaattataatcaattaatggcaatccagatgacaacaaaaacaacttaccaatggcctcaatctaaggatatttatccatatcgaccagggcgttttgatgcaccaaaacattggcgttataacttacgtagctttttaaatcgtggttcaattcgtcgctttgaacaatttatcaatcagcatccttttctcatcgatatttttaatacgcacttggattatagttatcctgttgcttgtcgttttttagataagcgttttaacgcatcacagcgttttcatgcggtttgtgagaatcttttatttttacccgaaaaacttaccgcactttctacgccgttatgggaaaaacctctaagttttggcgaagtcattcctgattttgaaatgacattaagcatgacaacccatcaaccgatggaaggatattgggtattggagctatggcataaaccaagaaacgaattagtctatttgcttacttttgccaaattgggcgatgcgttgcttattgctgttgtacaagggccaaattttgaaggctcaaaggaaatggtgaaacaactaaccaaattatgccacggtttacgccctgcctatttaatggttgaaaccatgaaatcactcacaaaaatactaggctacaataaattgctgggcattccacaaaaataccaaaataaatctcgtttcatccaaagcaaacaatatacagtggactatgatgcaatttttggcgaatcaggcggagaattaaaagattactgggaattgcctttagaaatggatagaaatctagatgatattccaagtaaaaaacgttccatgtatcgtaagcgttatgcgatgctagatgatttggctaaggtaattgaagaaaagttaggattgtaaaagtaaaaagtgcggtgaattttaaccgcactttttgttttataagactttcaagcaagccacaaaatggctgttgttttggctggtgaaaggtggtttttgtttcgcacaattctcatcagcctttagacagcgagtacgaaatacgcaaccagacggtggattaattggcgaaggcaaatcaccttcaagtaattcgatggatttattgcgttccaattttggatcggggatcggaacagcagacattaaggctttggtataaggatgtttggtatcgttatatacttccacatcgctgcctaattccattgcattgcctaaatacatcactaatacgcggtcagaaatatgttttaccaccgctaaatcatgggcgataaaaattaaggaaagccccatttctttttgcagggatttcaataaattcaccacttgagcctgaatcgacacatctaacgctgaaacgggctcatcacaaatgatcattttgggctcaatgattaacgcacgagcaataccgatacgctgacattgaccaccagaaaattcatgtgggtagcggttaatcaagttcggtaaaagcccaactttcaacatcatagcttgcactttttctttcacttcggcggcacttaagtgcggttggtagatctttaatggctcagcaatgatttcgccaatattcattcgcggattgagagaggctagtgggtcttggaaaatcatttgaatatctttacgcgtttctttccattgtttcgctgattgttttcgtaaatgtttaccaagccacaagatttccccttcactcgcttcgactaaaccgataatagcgcgtgcaagtgtggatttaccgcaaccagattcacctactacgccgagagtttcacctgcgtaaagtttaaaagacacatccttcaccgcttttaaggtttgcggtttggcgaagaaaagggatttatcatttttaattttaaaactgacgcctaagtgattgacttcaaggagtaattctttgttgtttgagactgtcataggttaaatttctccgctgataaccaacaattacgtaattgaccgtgattaaatgtagtcagttttggcgcaatttggcattgttcggtagcaaattggcaacgaggtgagaatggacaaccttttggcaaatgcaataaattcggtggattgccaggaatggttaccaagtgttcttcattgccgtctaagcgaggaatcgcatccattaagcctatggaatagggatgggttggatgatagaaaatttgttccgctgtgccgtattccatggttcgtccagcatacatcaccatgacttgatcgcagataccagccactaccccaagatcatgggtaatcataataattgcagtattaaattcacgttttagttcatttaataaagtcatgatttgtgcttgaacggtcacatccaaagcggttgttggttcatctgcaatgagtagtttgggacggcataataaggccatcgcaatcatcacccgttgacgcataccgccagaaaactcgtgcggatacatgcccatgcgttttttagcttctggcattttaactgcgtctaacattttcacggattcagcaaaggcagtttgtttatcatagcccttgtgcaattgcagcacttccatgagttgttcaccgattttcatgtatgggttgagtgacgtcattggatcttggaaaatcatggaaatttgctcggcgcggattttattcaattcagcattcggtaaattaactaattctttaccttcaaaaatggcagagccttccacttcaccgttggctgccaataaacccattaaagcaaaggctgtttgtgacttgcctgatccactttcgcctacgatgcccagcgtgcttcctgcattcagcgtgaagtttaagtcattcactgctgtaacgacgccatctggtgttttgaagcgaacgtagagattttttacatctaataaaggattcattattcgctcctatctatctttcggatcgagcgcatcacgcaacccgtcaccgataaagttaaaacaaaatagggtaaggcaaaggaaaaatgctgggaaaattaataaccaaggcgacacttccatttgtgcagcaccatcacttaagagtgcaccccagctactcatcggttcttgtgtacctaatcctaagaagcttaagaatgattcaaatagaatgagtccaggcacttcaagcgaggcataaactgccactaagcctaatacattcggaataatgtgtttcaaaatgatttgacgacgaggtacgccacaaacgatggcggcttcgacgaattctttattttttaggctgagggtttgtccgcgtacaatacgtgcaagaccaagccaagcaatggccccgatagcgataaaaattaagaaaatgttttggccaaaaagggtcaccaacaaaatcacgaaaaacataaatggaaatgagctaagaatttccaaaaagcgcatcatcagcatatctgttttaccgcctacataaccggaaatcgccccataaattgtgccgatagtgacggaaatgaaagcaccagcaataccgaccaataatgaaatacgtccaccgatagcagtacgtaccaacaagtctcgacctgaggcatcggtaccgaagaagtgatagccttccattgttggtgcggcgctcatcatattccaatcggtatcttcataggtaaatgggaagaaccaaggtgctacggtgataaatataataataaacgccaaaataatcagactggcaacggccgctttgttgcggaaaaaacggcgtttcgcatcttgccataggctgcggccttccagttgcatttcttcaatacggtcagccacttgttccacaaaatccgcatttttctgattaatcggctgagtacgataatctgtcataatttatccttaataacgaatttttggatcgatgatggcgtataaaatatccacaatcgcattaaataaaatggttaatgtccccactaaaatggtgaggctcaaaactaaagagtaatcgcggttcaatgccccgtttacaaataataatcccatgccaggtaaaccaaatacgctttcgatgaccattgagccagtaataatccctacgaaagcaggtcctaaataggttatcacgggtaaaagtgcggggcgcaaagcatgttttaaaatgattctcgacatggaaagtcctttagctttggcggttcgaataaagttggaatgtaacacttcaatcatcgaaccacgcatgatacgcgcaatccctgcaacataagcgatagttaaggaggctacaggtaagatcatgtacatggcggtaccgccgttccaaccgccagctggcagccatcctagataaatggcgaaaattagcactaaaacaggtgcgaagacaaagcttggcataatgaccccaagcatcgagaaactcatcaaaatataatcccaacggctattttgattgagagcggcgagcgtacctgctgttactcctagcacgactgcaaaggcgaaggccaccattcccaattttatggaaacagggaaagctgacgcgattaaatcattgactgattggtctttatatttaaaagagggaccaaaatctcctttggaaagattttctaaataaaggaaatattgtttatataatggttcatttaaatgatacttcgcttcgatattagccatgacttctggcggataagcgcgttcagaagtgaaggggctgccaggggcgagacgcatcaaaaagaaagaaaaagtaatcaaaataaacagcgtcggtaaggcttccaacagccgtttaaaaataaacttgagcataacaactccaaccaaaatgggcgaaaagtgcggtcaaaaaatacgacgatttttaaccgcacttaaatacgagtaacgaattaatgtttaataatataaagattgcgtaagtaaatatgatcttgtggatctttgcctgaataaccttttacgtaaggtttcactaagcgtggattcacatagttaaagattggtacgataccgtaatcttttccaagaatttcttcggctttcgcataagcttttgcacgaccttctgcatccgttgctgcgtaagattctgccatcgctttatcatattctggattcgcatatttcgcggtattgttactagaattagataagaaatagttgccgaatgttgttgcttggttgtaatccgcattccatccagcacgcgccacatcgtaacgacctgcacgacggctatcaatgtaagttttccactcttggttttctaatttcacgtcaatcaaacctttggtgttagctttccacatagatgctgcagcaatagccacttttttgtggttttcattggtattataaagaatgctgaatttcaacggattcgctttactgtaaccagcttcttctaagagtttaatggcttcttcattacgttgtgccatcggttcttttgaataagcaggttgttgaatgagatgaccttcttcgatgtaagttggggtaaacacataggttggtgtttgaccttgacccaatactttatcggtgatcacattacgatcaagggataagttcaaggctttacgaatattcacgttatcaaaaggtgctttcttattgtttaattcataagaataagttcctagggtacgagtaacgtatacttcgcctggcaattctttttgtaatttagcgaattgttctggcggtaaaccataactggtcatgtctaaatcgcccgcacgataacgcgctacatcggtacttgggttttcaatggcgaggaatgtcgcgctattgattacggtttctttatcgttccaataaagtgggttacgttcaaattcgattttttcgttaatgatgtggttagccagcttatacgcaccgttacccacgtagttttcttttttcacccatgcatcacccaatttttcgactactttttntggtaatggcaataaggattggtgagtcgnnaaactgactgtataaggcacaggattggttgtatgaaccacaaaggtgtaatcatcttttgnttccacgcctaattcagccggttttttcttaccgtcaataatgtcttgtgcattttcaacttgtaaattaacttaggtaactcgcgtaaggtgcagcagttgcaggatccactaaacgacgccacgcaaacacgaaatcgtgtgcagtaacaggatctccgtttgaccatttagcatctttacgtaaatggaatgtccaggttttgaagtcaggtgtattttcccagctttcagccgcacccggttgaagtttaccttcagagtctgaggtgactaagccttcaagtaattgataagcaacgttagattctggcacaccttcggttttgtgtgggtcaaaactttgcggttcagccccgttattgatgacgatatgttgtttttcatctaattgtgttccttcaggcactataactgcttgcgcagaataggaaagggcaagagcgattgcagagaagagtagtttgtgttgcatttgagcctccttgtcattaggcgatatttttataaaaagtcttctatttattagctcaaaaattcatttttgtaaagatttgtcaggaaattatttgaagaaaaattgagttttgtgagttgtgtctaataaatcgctaaaaaaattgctaaaagtgatgatatgagaggcgggggatctaggatgtattgatttttcctattgtaaatattttcctacataaattacccttttaatgctaattgtgctatcgtaacctgattagatttaaacaagtccattcaaggagaatacaatgacaacacagttagattcacttcgtaatatgaccgtngtcgtagctgatactggcgatattgatgcaatcaaaaaataccaaccacaagatgcaacaacaaacccatctttaattttaagtgcttcagcattaccacaatacgccccattaattgatgaagcggtanttatgcaaaagcacaaagtcagacaaagcacaacaattaattgatgctgaagataaattagcggtaaacatcggcttagaaattttaaaaattgttccaggacgcatttcaacagaagtagatgctcgcctttcttacgatacccaagcaacggttgaaaaagcgcgtaaattaattgcactttataatgcagcaggcatctcaaatgatcgtattttgattaaaatcgcttccacatggcaaggtatccgagctgcagaaatccttgaaaaagaaggcattaactgtaacttaaccttattattctctgaagcgcaagctcgtgcttgtgcagaagcgggcgtttacttaatttctccatttgtaggtcgtattttagactggtacaaagcaaattcagacaaaaaagaatatgcgccagcagaagawccaggcgttatttctgtcaccaaaatctataattactacaaagaatatggctacaacacagttgtgatgggcgcaagtttccgtaatgtaggtgaaattactgaacttgcaggttgcgatcgtttaaccattgcaccagcattactgaaagaattacaagaaaattcaaccgcacttgtacgcaaattagaatacaaaggcgaagtaaaagcgaaaccacaaccattaacagaagctgagttctactggcaacataacagcgatgctatggctgttgaaaaattagcagagggtattcgtaaatttgctattgaccaagraaaattggaaaccatgctttcagcaaaactttaatccatcattcaatataaaaaataaccgcacttcaatctgctcttgaaatagttaaagaaaatatttaactaatttgggtgcagattttttatttattaagatataaaagtgcggtaaaaattcggtgtatttttgtttatttacncctagcngcaatagataatggttacagaaatattattaagtaatacattttcataacnaaatagatgaaatttattataaaaatattttaataaagataaattatatttttaatttatactaaattagtagttagaattttnacttgcgataatatcagagaaaagtggtagtcttcccaagattttatacattctggaatgattaccatttgatatatgattataaattagcttaataaatcacttaatttcttaattaagataatttttctttcctcaaagaattgatcaaaattatcaatagataagtccacatcaggtataaagatggttgtcgaaaaaagaggttatattagattttgtatttttatttacccattcttcaagagaagcatcttttttcgatgtattttcatcaagccattgtaagttataaatagaattataatttttatcagctttttgagttaatagtaactccttaataaatttatcattgatagattaatttaccatccagcttgtgactgcgataaaaattgcaaagatgcaaaaccaaattatgtggagttttgtgcttttacgattgacttcttcattatgtaagcgtcgagcttctaatctttgtttgtacatctctagatctttttgtttgaaagagaagccgcaattagggcaattttctgcattttcactaatcttttttctgcattcagggcatcttgttaaggacatatttgcttttatacctattcaattacttatttattagcattttaatggatgttttagattttacaaatgtgatacaagtcacaaatcttataaaaatctttaaattcaattttgatttgacgtaatttgaaatagaatacagccgcttgtttagggcatataaatacttttactttattttttgaggagccttcctatgttatggtttttcttttgtgtaaccgtgttgattatcggttactttatttatggaaaaattatcgaaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgtagcaatgctttggattgtnattggttgtatttttgctggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgtttcgcaaggtgcgttagtgcttggtgatgcagaggcagttcatcattctgttgaagctggtgggattaaagtatggggaatggataaagcaacagtggttgctgtgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatggcacgttgtacagaaaatgaaagtgaaggtcgcttcattttctacggtgcaatgattactgagggggtaattgcattagtatggtgtatggttggtcttgcattctatgaaaatccacaagcgttacaagatgcaatttcagcaggttgctccatgctaaagttgtgtatgatagttcgttacatttcttaggttttattggtggtatttttgcnatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactgcagcgggatatttatatcgttatcataaattccactgggttgcgtctcttcctgcgtggtttatcacaacagtatgtgcacttatttgttctacaacaaaattggtttcggcttagattatcagctttctgtgtatctnggtttagcaacaaccatcgtttgtatcgtattgttcttcacaatgcttaaaccattaggtacgcgagatgaagaagcttatataaataattagtcaataaaattttatgaaaaaagnngtttgaattgtttattcaaacggcttttttattttgataaaaatcagttgctttaatgtggaattacttgcaagttgagcgaacaaattataaacttgccagaagtggagaaaagtggtgttttgtggagatttttagagattttctaaaaataagttcaatttttaaggcgtaatatgtttcgtggtgcaacggcggttaatttagattctaagggacgtgtagcgattccaactcgctatcgcgctgaaattcttgaaaagaaccaagggcaaatggtttgtactgtagatattcgtcaatcctgtcttttactttatccccttgatgaatgggaaaaaatcgaacaaaaacttctcgcactttctaactttgatcctacccaacgccgtttgcagcgagtaatgcttggtcatgccactgaatgtgagatggatgctcagggtcgtattttgcttagtgggccattacgccaacacgcaaaattagaaaaaggtttaatgttggtagggcaacttaataaatttgaaatttggagcgatgtagaatggcatactcaaattgcagaggatatagaaattggctccagcacagattttgctgctgatgcgttaaatgatttctcattatagaaaataatgtagtacttttatcttaaatttatgaatagcgaaaattccttttcttcatctgaacatattacagttttacttcacgaagccgtgaatggcttggcattgaaggagaatggcatttatattgatggtacttttgggcgtggggggcattctcggtttatcctttctcaactttcttctaatggtcgtttgatagctgtagatcgcgatcctcgtgctattgcagaagcacacaaaatccaagacttgcgttttcagattgaacataacagcttttcgcatattcctgaaatttgtgacaaattaaatttagtgggcaaaattgacggtattttgcttgatcttggtgtgtcttcccctcagcttgatgaagcagaacgtggttttagttttatgaaagatggcccgcttgatatgcgtatggatacaactcaaggtttatctgctgaagaatggttaaaacaagtgtccattgaggatttaacttgggtgttgaaaacttttggcgaagagcgtttcgctaaacgtattgccactgctattgttgatttcaataaaagtgcggtaaaaaatggcacagaatttttatcgcgtaccagtcaattggcggaacttatttcacaggcagttccttttaaagataaacataaacatcctgcgacgcgtagtttccaagctattcgtatttttattaattcggaattagatgaattagaaagtctgcttaattctgcgttagatatgttagcaccagaaggtcgtttatcaattattagtttccattctttagaagatagaatggtgaaacattttatgaaaaaacaaagtaagggcgaggatattcccaaaggtttaccattgcgagaagatcaaattcagcgtaatcaaaaattaagaattattggtaaagccattcagccaagtgatgcagaaattcaagccaatcctcgttcaagaagtgccatattacgtgtggcagagagaatttagcgatgtctgaaaataataagcctcgttatccgttacagcagattttagtcgaagatttattttcttcaaataagttagtggtgttgctgttaatagggattttagtttctgcaatggggacgatttggataacccataaaactcgccaattaatttctgaaaatggaatgttaattttacagcgtcaagcacttgagaatgaataccgtaatttacaagtgcaggaagctacggaaggggatagcacgcgagtagaatctattgcgattagtacattaaaaatgaaagttgtttcttcagagcaagaagttgaaattagagaataataggtaaaaaaaatggtgaaatttaattcctcgcgtaaatcaggtaagtcaaaaaaaacaattagaaaattgaccgcacctgaaactgtaaagcaaaacaagcctcaaaaggtgtttgaaaaatgctttatgcgtggacgttatatgctttctacggttcttattttacttggcctgtgtgctttagtcgcacgagcagcttatgttcaatctattaatgccgatacgttatcgaatgaagcggataagcgttctttgcgtaaagatgaagtattatcggtgcgtggttctattttagatcgtaatggtcagcttttatctgtaagcgtgccgatgagcgcgattgtggcagatccaaaaacgatgttgaaggaaaattcgcttgcggataaagaacgaattgcagctttagccgaagaattaggtatgactgaaaatgatttagtgaaaaaaattgagaaaaattctaaatctggttatttgtatttagcacgtcaagttgaattaagtaaagctaactatattcgtagattaaaaattaagggtattattttagaaacagagcatcgccgtttttatcctcgtgtagaagaagctgcacacgtggtgggttatacggatattgatggaaatggtattgaaggcattgagaaaagttttaattccctgcttgttggtaaagacggttcacgtactgttcgtaaagataaacgtgggaatattgttgcacatatctccgatgagaaaaaatatgatgcacaagatgttaccttaagtatcgatgaaaaattgcaatctatggtgtatcgtgagattaaaaaggcggtgtctgagaataatgctgagtctggtactgcggtgttagttgatgttcgaacaggggaagtgttagctatggcgactgcgccctcttataatccaaacaaccgtgtcggcgtgaaatcagagttaatgcgtaaccgtgcaattaccgatacttttgagccaggttctacggtaaaacctttcgttgttttaaccgcacttcaacgaggtgtagttaaacgagatgaaattattgatactacgtcctttaaattaagcggtaaagaaattgtggacgttgcaccacgtgctcagcaaactttagacgagattttaatgaactctagtaaccgtggtgtaagtcgtcttgcattacgtatgccacctagtgcattaatggaaacttatcaaaatgcaggtttaagtaaaccgacagatttaggcttgatcggagagcaagttgggattttnaatgcaaatcgtaaacgctgggcagatattgagcgtgcaacagtcgcttatggttatggtattactgcgacacctttacaaattgctcgtgcctatgcaacccttggtagtttcggtgtttatcgtccgctttctatcactaaagttgatccgccagttattgggaaacgggttttctctgaaaaaataactaaagatattgtgggaattttagagaaagtagcaattaaaaataaacgcgcaatggtggaaggctaccgtgtcggcgtaaaaacaggtacggcacgtaagattgaaaatggaacattatgtaaataagtatgtggcatttactgcgggtattgcaccaattagtgatcctcgttatgcattagtggttttgatcaatgatccaaaagcaggagaatattatggtggtgcggtttctgcccctgtattctctaacattatgggctatgcgttacgtgcaaatgctattccgcaagatgctgaagcagctgaaaacacaacaacgaaaagtgcaaaacgtattgtttatattggcgaacacaagaatcaaaaagtgaattaaggaaaaattatgaaaaaactcaccgcactttttaatttgcctgaattaaagaatgatatagaactccataatatggtgttagatagccgtaaggttaaagctggcgatctttttgtggcgataaaaggtcatcaggtggatggaaatcaatttattgattctgctcttcattctggtgcgagtgcggtggtttctgagacagaattatccagcgagcatttaactgtagcgtttatcgggaatgttcccgtagtgaaatattatcaacttgcacatcatctttcatctttggcggatgttttctatgattcgccctctaacaatttaacccttgttggtgtcacggggacaaatggcaaaaccactatttctcaattattagcgcaatgggcggaattattggggcatcgtgcggctgtgatgggaaccattggtaatggactttttgggcaaattgtagaagctaaaaatacgacaggttcagcagtagaaattcagtcatctctttcagctttcaaacacgcaggtgcagattttacctctattgaagtttcatcacacggtttggcgcagcatcgtgtagaagccttgcattttaaagcagcaattttcacgaatttaacccgtgatcatctagattatcatcaatctatggaaaattatgctgcagcgaagaaacgcttgttcactgaattagatacccaaattaaagtgattaatgctgatgatgaaattggataccaatggctaactgaactacctgatgctattgccgtaagtatgaatgcggattttaaagtaggttcacaccaatggatgaaagcaataaatatccattatcattttaaaggtgcagatattacttttgaatctagctggggtaatggtgttttgcatagcccattaattggtgcttttaatgtaagtaatttattattagtaatgaccacgttgttatcgtttggttacccattggaaaatttactcgctacggcgaaatctttaaaaggagtatgtggaagaatggaaatgattcaatatccaaataaaccaaccgttattgtagattatgcgcatacaccagatgcgttggaaaaagcgttgattgctgcgcgtgaacattgccaaggcgaattatggtgcatttttggttgtggcggagaccgtgatagaggcaaacgtccgttaatggcacaggttgcagagcagtttgctgaaaagattattgtgacaaaagataatccacgaacagaatcacaaagccaaattgaaacagatattgtcgctggctttaaaaatatggaaaaagtggggattattcctgatcgcgcacaggcgatccagtttgcgattgaaagtgcggtagaaaatgacgtgattttaattgctggaaaggggcacgagcattatcaaattattggttcggaagttgtgcatttttccgaccaagaaattgcacttgatttcttaaaataataatcactcaattatgattaaactctctactgtacaacttgcacagattcttcaagctaaattaattggcgatgaaaatgtgcaagttgaaaaaattaatacggatactcgaaaaagcgtatcaaatagcttattttttgctttaaaaggcgaaaaatttgatgctcatcaatatcttgatcaagcggtgtcacagggtgcgcttgcgcttgttgttcagcaagaaaattcatccatttctgttccacaattggtggttaaggatacccgtattgccttgggtgaacttgcaaaatggttacgtgagaaaattaatccacgtactgtggcgatgaccggctcttctggtaaaaccacggtaaaagaaatgacggcaagtattttgcaacataccgcagcggattcagaagcggtactttttaccaatggtaacttcaataacgatataggtgtgcctttaactctacttcgcttaacagaaaaacatcgttttgctgtgattgaacttggtgcaaatcatcaaaatgaaatcaattacaccacaaaattagttcaacctaatgccgcattgattaataatattgcgcccgcacatttagaggggtttggttctttagcgggggttgttcaagcaaaaggcgagatttatcgaggtttaacaaaaaatggtgtggcgattatcaatgctgaacataatcacttagatatttggcaaaaagaaatcagtaatcacgccattcaatatttcaacggtaaagattattctgcaaaaaatattcatcatacttctcaaggctccacttttacacttatttccccacaaggtgaaattgagattaccttaccttaccttggtgaacataatgtaaaaaatgccttggcagcgaccgcacttgcaatgaatgtcggtgccactcttacagatgtaaaagctggattagaacaacgttcacaagtgaaagggcgtttattccccattcaagtcacgcctaatttattgctgttagatgatacttataatgcgaataaagattctctgtgtgctgcgattgatgttttaaaaggttatgatgctttccgtattttgtgtgtcggtgatatgaaagagctaggcgaaaactctctcgctattcatcgtgaagttggacaatatattaatttggtaaatttagatttagtgtgttcttatggcaatgaaagtgcggttatttctgaggctgtttcgggtaagcattttacggataaaactgaaatggtggatttcttagttccacttattgaaaaccaattacaacaaaataaaaaagttgtggtgctaggaaaaggctcacgctcaatgaaaatggaagatgtgatctattcattaaaggataaaattaaatgttagtctggcttgctgaatatcttgttcgttacgaaaccgcgtttaatgctatttcttatattacagtccgcgcaaatcttgcattattaaccgcactttttatctcactttggattggccctaaagtgatcaaacgcttgcagatcttaaaatttggccaagaagtgcgaaatgatggccctgaaagtcactttgcaaaaaaaggcacacccactatgggtggtgtgatgattttattctctattggcgtaagtacgttattatgggcaaatcttgctaatccgtatatttgggtttgtttatttgttttatttggatacggcgcaattggttttgtggatgatttccgtaaaattacccgtaaaaatactgatggattgattgctcgttggaaatatttctggatgtctgtggtggcattagtggcaatcctttggctttattggcttggtcacgacactgatgccacccgtttagtgattccattctttaaagacattatgcctcaattaggtttgttctatattgtgttatcttactttgtgattgttggcacgggtaatgcagtgaatttaaccgacggtttagatggattagcgattatgcctactgcgcttgttgcaggtgcgtttgctttaattgcttgggctacaggtaacgtgaatttcgcagaatatttgcacattccgtatattaaatacagttctgaagtagtggtgttctgtacagctattgttggcgcgagtttgggattcttatggtttaatacttatccagctcaagtatttatgggggacgtgggttctctagcattaggtggtgcgctgggtgttgtagcaattcttgttcgtcaggaatttttgcttgtgataatgggtggtgtatttgttgttgaagcactctctgttattttgcaagtagggtcttataagttacgcaaacaacgcatttttagaatggcaccgattcaccaccattttgaattgaagggatggcctgagccaagagtgattattcggttttggattatttccttaatgctggtgttgatgggattggtcaccttgaagttgcgttaataaatatagctaggttcgctctttcacttttgaaagagcgaccttttttacgttagtaaaggaaatttatatttccatcaatgatataattttaaaatttatagcaattaagaagaaagaaaatgaacgcctatcaaaacaaaaatattactatcatcgggcttggcaaaacaggtctttcttgtgtggattatctcttatcccaacaggctaatattcgtgtgattgatactcgaaaaaatcctactggtattgataaacttcctcaaaatatccctcttcatactggtagtttaaatcaggaatggttacttgaaagcgatatgattgttattagcccagggcttgcggtaaaaacaccagaaattcaaaccgcacttaaagcgggagtggaagtaatcggcgatattgaattattctgccgcgcagcgacaaagccaattgtggggattacaggttcaaatggtaaaagtaccgtaactactttagtttatgaaatggcgaaagctgctggtgtgaaagttggtatgggcggaaatattgggattcccgctttgtcattgttgaatgaagattgtgaactttatgtactagagctttctagttttcagcttgagacaacttatagcttaaaagctgcggcagcgactgtcttgaacgtgactgaagatcatatggatcgctatatggatttagaagattatcgccaagcaaaattacgcatttatcataatgctaaagtaggtgtgttgaacaatgaagataggctgacttttggggaaaacgaaaatcaagcgaaacataccgtttcttttgcggaaaatagtgcggattattggctaaaaactgaaaatggcaagcaatatttaatggtaaaagatgaagtgattttaccttgtgaagaagctacattggttggtcgccataattatatgaacattttggcagcaacagcattggcacaagctataggtattaatttagattcaattcgtaccgcacttcgtcatttcaaagggttagatcatcgttttcaattagtgcatcaagctaatggcattcgttggattaatgactctaaagcaacaaatgtggggagtacagttgctgcattggctgggctttatattgagggtaaattgcatttgttgctaggcggagacggaaaaggggctgatttttcagaattagctgaattaattaatcaaccacacattatttgttattgttttggtcgagatggtgcgctgcttgcaaaattttcatcgcaaagttatttgttcgatacaatggaacaagcgatagaatttttacgcccaacattgcaaagcggagatatggtattattgtcgcctgcttgtgcaagtctcgatcagtttgcttcttttgaaaagcgcggcgaagaatttacgcatttagctcaatgtttaacctaatttagtaactcacgaaataagatggaatttttacaaaatatcaaaaaaaattacgatgaatggacacgcatcacacctcaaggtttgttgtatgatcgcgcactattttggttatttgttattttgcttttaattggtttagtggcagtaacatctgcttctattccttatagctctcgtttatttaatgatcctttttactttgcaaaacgcgacgctatttatgtgctacttnctttactcacttgttatatttcattacaaatttcttcttcgcaatgggaaaaatggcacgctaaaatttttttattttctgtcatattattattgcttgtcccttttatcggtacatcggttaatggcgcaaaacgttggatttcgttgggaatcttaaactttcaacctgcagaatttgcaaaattggctttgacttgttttttagcaagttatttcactcgtcgttatgatgaagtgcggtcgcgacatgttagtatttttaaaccgtttattgttatgcttgtattgggttgttttcttttattgcaacctgatttaggtagtacagtcgtgctatttattattatgtctgggatgctttttatcgtaggggcgaaaattttacagtttgtaggattgatagcattaggtggaatcttattcgtttggctagtattgaccgcctcttatcggttaaagcgatttataggttttttagaaccctttaaagaaccttatggcactggtttccaattaacaaactctcttatagcatttgggcggggagaaattactggcgaaggattaggtaattcaattcaaaaattagactatctgcctgaagcacataccgatttcattatggcgattatcggcgaagaatttggatttatcggtatattgattgttattcttttattaggtttattaatttttcgtgcaatgaaaattggacgagaatccttaatgttagaacaacgttttcgaggtttttttgcattaggtattggtttttggatttyctttcaaggctttgtgaatttaggtatggctcttggaatgctaccaactaaaggtttaacctttccactcgtgagttatggtggttcgagtattatcattatgtccgccactattggtattttattgcgaattgatcacgaaaatcgtttatttcgtataggtcaagcacgcttgcgtgatgattagagatagaaaagatgaaaaataaaaaattattagtgatggcgggtggtactggcggtcatgtttttcctgccattgcagttgctcaaactttacaaaaacaagaatgggatatttgctggttaggtacgaaagatagaatggaggctcaacttgtaccaaaatatggtattcctattcgatttattcaaatttctggtttgcgtggtaaaggtataaaagctttgttaaatgcgccttttgccatttttcgtgcggtgttgcaggcaaaaaaaattattcaagaagaaaagcctgacgctgtacttggtatgggaggctatgtttctggccccgctggcgttgcggcaaaactttgtggtgtaccaatcattttacatgaacaaaatgcgatagcgggtttaacgaataagttattaggtaaaattgcaacctgtgtattacaggcatttccaactgcttttcctcatgctgaagtagtaggaaacccagttcgagaagatttatttgagatgccaaatcctgatattcgtttttcggatcgtgaggaaaaattacgtgtcttagtggttggtggtagtcaaggagcgagagtgcttaatcatactttacctaaagtagtcgcccagcttgcagataaattagagtttcgtcatcaagtaggtaaaggtgcggtagaagaagtcagccaactttatggcgagaatttagaacaagttaaaataacagaatttattgataatatggcagaggcttatgcttgggctgatgtggttatttgccgttctggcgcattaaccgtatgtgaaattgcagcagtgggagccgcagcaatttttgtaccattccaacataaagatcgccaacaatatttaaatgcgaaatatttatcagatgttggcgcggcgaaaattatagaacaggcagatttaacgcctgaaattctagtgaattatttaaaaaatttaactcgtgaaaatttattgcagatggcattgaaagcgaaaacaatgtcgatgcctaatgcggcacaacgtgtagctgaagtaattaaacaatattcaaactaggggttgtggcgttttataaatagcctcagtcataagtattttttatatccaaaagtgctaatattagaaataaaaacgttgcgaattttaaccgcacttttagttgagttttgtcattgggagaaaaggaaaaataaatgaaacattcccacgaagaaattagaaaaattatccctgaaatgcgccgtgtacagcaaattcatttcattggcattggtggtgcgggaatgagcggcattgcagaaattttattaaatgaaggttatcaaatttcaggttcagatattgccgatggcgtagtcactcaacgtttagctcaagctggggcaaaaatctacattggtcatgcagaagaacatattgaaggtgccagtgttgttgttgtgtctagtgcgataaaagatgataaccctgaattagttacatcgaaacaaaaacgcattccagtgattcaacgcgcacaaatgttggcggagattatgcgttttcgtcacggtattgctgttgcaggaacacacgggaaaacgacaacaacagcaatgatttcaatgatttacacccaagctaaacttgatccgacttttgtaaatggcggtttagtgaaatcggcgggtaagaatgcacatttaggagcaagtcgttatttaattgccgaagccgatgaaagtgatgcgtcgtttttgcatttacagccaatggtatctgttgtaactaatatggagccagaccatatggatacttacgaaggcgattttgaaaaaatgaaagccacttatgtgaaattcctgcataatttacccttctatggtttagccgtgatgtgcgctgatgatcctgttttaatggaacttgtgccaaaagttggtcgccaagtgattacatatggttttagtgaacaggcagattatcgcattgaagattatgaacaaacaggttttcaaggtcattacacggtgatttgcccaaataatgaacgtattaatgtgttgctcaatgttcctggaaaacataatgcattaaatgcaacggctgcacttgctgtagcaaaagaagagggtattgctaacgaggcaattttagaagctctggctgattttcagggggctggtcgtcgttttgatcagctaggcgaatttattcgtccaaatggtaaagtgcgtttagttgatgattatggtcatcatccaacagaagtaggcgtaaccattaaagcggcgcgagaaggctggggagataaacgtattgtaatgattttccaaccgcatcgttattctcgcactcgtgatttgtttgatgattttgtacaagtgctttcgcaagtagacgctttgattatgcttgatgtgtacgcagcgggagaagcccctattgttggcgctgacagtaaatctctttgccgttccattcgtaatcttggtaaagttgatcctattttggtatcagatacttcgcaactaggcgatgttctcgatcaaattattcaagatggcgatttgattttggcacaaggtgctggtagcgtaagtaaaatttctcgtggcttggctgaatcttggaagaattaatgccagatggattgattgaaaatcttagtattagaaaagtatcatcagtaagaagaaaaacaggatagaaaatgaacttaaaacaagaaaaaatcgcggtgttattaggcggcacatctgctgaacgtgaagtttctctcaattcaggcaaagcggtattagaagcattattaaagcaaggttataatgcacatcctattgatcctaaagaatataatgttgcaaatcttaaaaaggatggctttaatcgagcatttaatattttgcacggtcgtggtggagaagatggcacaatgcaaggtttattagagcaaattggtttgccttatacgggttgtggcgtgatggcttctgcattaacgatggacaaaatgcgtacaaaaatgttgtggaaagcttttggtttacctgttgcagatatgaaagtggttacccgagaaactttttctgaattggatcctcaggctgttgtggcaaaattaggcttaccattaatggttaaaccctctttagaaggctctagcgttggcttaacgaaagtaaaagcggtagaagagttaaaaagtgcggtggaatatgcgcttaaatttgataataccattctaattgaagagtggttagctggcgatgaattaactgtgcctgtgcttgacaatcaagtattacccgcaattcgtattgttccagagggcgaattttatgattatgaagcgaagtatatttctgataatacgcaatatttctgcccagcaggtttaacgcctgaacgcgagcaagcgttatcaacattagtaaaacgtgcttatgatgcagtgggatgtcgtggttggagtcgtattgatgtaatgtgtgatgcaaaaggtaatttccgtttggttgaggttaatactaatcctggaatgacgagccatagtttattcccaaaatctgcagcgacagtaggtatttcttttgagcaactcgtcgtgaaaattttggagctgagcctgtaatgaacattctgaaaagaaaaacgccacagaatattcgttttggagaacaaaagcctaaatattattttcatattcgggcttttgcggtattgcttggtgtcttttttttacttggtgtttattttaattggcaaagcattttagaaaaaatggatgataagccgattagcgcatttgcacttgttggacaaaatacctttactactgctgatgatattaaagaaagcctattaaaaatgggcgaattaaaaggattttgggggcaagatgtggcaccgattcaagagcaaattgaggctttaccttgggttaaaggtgcaatagtaagaaaaatgtggccaaatcgtttaagtatttgggtatcagaatatcaacccgttgcgttttggaatcaaaatcaatttgttacccttgatggtatcgtttttcagcttccctctgtacgtttaactgcaaaaaatttgccctatttgggtgggcccgattatcagagtttgaaagtaattgagacgtggaaccaaatttatattaatttaaaatcaaataatataatggcaaagggaattaatattgatgatcgcggtgcgtggcaggtccagcttgataatgatattgtgctaaaattaggtcgtggcgattggaaatcaaaacttgagcgatttgtcacaatttatccgcaaattgatgtgccagaaaacaaaaaaatagattatatagatttaagatatacggcaggtgcagctgtaggtatggttgatagataaaaataactgggtgcgaaaatggttaaaggtgtggaaacaaaaacaatagtaggtttagaggttggcacgtcaaaagtggtcgttgtagttggcgaagtatttcctgatggtgtagtgaatgtgcttggtgtaggcagttgtccttcaaaagggattgatcgtggcagcatcactgatcttgatgccgtggtgggttcgattcaacgtgctattgaagcggcagaatctatggctgattgtcagattatgagtgtgactttagccattactggagagcatattcaaagcctcaatgaaagtggttttgtgccgatagcagaaagtgaagtaacacaagaggaaatcgattccgcacttcatacagcaagctcaataaaattgccagaaggcttatctttattgcatgttattccacaagaatacgctgttgatcgtcagatgaacattaaaaatccattgggattacaaggcgtgcgtttaaaagcacaagtacatttgatcgcttgtcatcaagattggcaaaataacttaaaaaaagccgttgaacgttgtggattgcaagtggataaagtggttttctctggttttgcagcaacacattctgtgctaactgaggatgaaaaagatctcggcgtgtgtttaattgattttggtgctggcacaatgaacgtgatggtttatacgaatggcgcattacgttttagcaaggtaattccttacgcaggaaatattgtgacaaatgatattgcgcacgcttgtacaatttcgcgagcagaagcagaacggatcaaagtgaactatgctagtgcattttacccagctcgtttgcacggagataaaaaaattgaagtggcaagtattggcggtcgtgcgcctcgttcattaacaaaaagtgatttatctttaattacatcagctcgttatacggagcttttaggcgtggtaaaagatgaattagataagttaaaagctgaattagaagcaaaacatattaaatttgaattaattgcaggtgtggtaataactggtggtggagcgcagattgaagatcttaaagaatgcgcttcaaatgttttccattgtcaggtgcgtattgcgagtccattaaatattactggtttgactgattacgtgaatcgtccacaatattcaacggtggtgggactattgcaatataattacagtaatagtgatgatgatttaatttcaggaagtgatgattctgaaggaactttctttgaatctatttggcaaggagtaaaaaaaattgtcaataaagtgcggtcagaattttgattattttaatttttcatctacaataaagggaatttatattttatatatttagtcagcttatctggcagtaacggagaacatcaatgctatacccagagtaccctgagtacgataattttaacgaatccggcgcrctgatcaaagtcgtaggtgtaggcggtggcggtggcaatgccgtaaaccatatggtaatgaatatggtaaaacaagaaatgggcggaacctttgttggcgaaagttcattaacatcagaggaacacggtcgcatagtattttatgccgtcaatactgatgctcaagcattgcgtaaaagtcaagttcaacagaccgtacaaattggtggagaaacaaccaaaggtttaggtgctggggcaaatccgaatattggtcgtaaggcagctgaagatgatcaggatgaaatccgcaaaatgcttgaaggtgccgatatggtctttattgcagcaggtatgggcggcggcacaggtacgggtgcggcacctgttgttgctaaaattgctaaagaactcggtattttgactgttgctgtagtgactaaaccttttacctttgaaggcaaaaaacgtatgcaatttgcagagcttggtattaaagatttatcccaatatgttgattcaatgattattattccgaatcaacaaatccaaaaagttctccctaaaaatgctaaattaattgatgcttttgctgctgcaaacgacgtattgcgtaattctgtaatgggaatttcagatatgattacctctcctggtttaattaacgtggacttcgctgatgtaagaacggtaatgtcagttcaagggcaagctatgattggttttggttcagctgtgggagaacccggtgcaggtagagcagaagaggcagctcgtcttgcagtacgcaatgatcttctagaaaaaatcgatctttctaacgctcaaggaattttagttaatattactgctggaatggatttagtttttgaagagtttaacattataggtgagacaataggtagttttgcttctgaagaagctacagttgttgttggtacgagtttagtgcctgagatgagcgatgaaattcgtgtaactattgtggcaactggtctcggtgaaattgcaggaaatgaaccaattcaggttgttcgtcaagggctttctacgcagaatattgaaggtgaaggacgtgtaaacattgttcctgaacttcatcgtcgtgaatctgttgaagtgtcaagaactgcatcagaagaatatcaacggccgttagataaaccgattacagatcgcttggaagcatttaagaaaaataatttctttaatcctgcacagcgtgaagaaaattaataagtttcagnaaatacctagtaaatgaaggtagtagaatgattaaacaaagaacattaaaacaaagtattaaagttacaggcgttggcttgcatagcggtgaaaaagtgacattaaccttgcgcccagctatgccaaacactggtgttgtttattatcgtacagatttaaaccctgcggtggcattccctgctgatcctaattcagtgcgtgatacaatgctttgtaccgcactaattaatgaacaaggtgtgcgtatttctaccgtcgagcatttaaatgcagctttggcagggcttggtattgataatattattattgaagttgatgctcctgaaattccaattatggatggtagtgctagtccgtttatctatttgttgttagatgcgggaattgaagaacaaaatgcagcgaaaaaatttattcgtattaagcaatatgttcgagttgaagatggcgataaatgggctgaatttaagccttacaatggttttcgtttagattttactattgattttgaccatcctgctattggcaaagatgtacgtaactatgaaatgaatttttctgcccaagcatttgttcatcaaattagccgagcaagaacttttggctttatgaaagatattgaatatcttcaatctcaaggtttagtattaggtggtagccttgataatgcgattgttcttgatgattatagaattttaaatgaagatggtttacgttttaaagatgaacttgttcgtcataaaatgttagatgcaattggtgatctttatatggctggttataacattatcggtgattttaaagcctataaatcaggtcacggtttaaataacaagttacttcgtgctgttttagcaaatcaagaagcgtgggaatttgtaacctttgaagataaagcgcaagtgccacaagggtatgtagctccagtgcaagtgcttatttaattgttttattgttgaaaaagctatatttctggtgggaagtatagcttttttgtttcatctcgtgcttaaatagcgaatgtactaaaagtgcggtcaatttcgtgggattttttataaggaagcattatggcattagaattatctgacattcgccaacaaattacgcaaatagatcgtagtttattaaaattactttctgagcgtcatcgtttagctttcgatgtagtgagaagtaaagagatctcgcaaaaatctttacgtgatgtagagcgagaacagcaacttttacaagaactagtgcaatttgcagaaaatgaaaattatcagcttgaagcacaatatatcacttcaattttccaaaaaatcattgaagactcggtattgacccagcaagtctatttgcaaaataaacttaatgaacaacgtaatcaaaatttacatatcgcttttttaggtaaacgtggttcttattctaatttagctgcacgtaattatgctgctcgttatcaaaaacaatttgtagaactaggatgtcagtcttttgagcaagtatttgaaaaagttcagactggagaagctgactttggtgtgttacctttagaaaatacaacatcgggtgcaattaatgaagtttatgatttacttcagcatactgatttatcattagtgggagagttggcatatccaatcaaacattgcgtacttgtcaatgataagacagatttgaaccaaattgatacgttgtatagtcatcctcaagtgattcaacaatgtagtcaatttattcatagccttgatcgcgtgcatattgaatattgcgaaagtagttcacacgcaatgcaattagtcgcaagtttgaataaacctaatattgcagcattgggcaatgaagacggtggaaaattgtatggacttagtgtattaaaaactaatattgctaatcaagagaacaatattacgcgttttattgtggtggctaaagagcctcgcgaagtttcatcacagattcccacaaagaccttattattaatgacaacttcacagcaagctggtgcgttagtggatgctttattggtgtttaaaaagcatcaaatcaatatgacaaaactggaatctagaccgatttatggtaagccttgggaagaaatgttttatctagaaattgaagcaaatattcatcatccagatacaaaacaggctttggaagaactaaaaaattatagtaattacttaaagattttaggctgttatcctagtgaaattgtaaagcctgtgagcgtgtaaaaaaagtgcggtcaataaaaataatgtttttatgaccgcactttttatatttttttgttccgttctaaagatttatgttgaattttcaccgtttttcctttggcttgaaaatattcgcctaattgctgggcaatataaacggagcgatgttttcccccagtacatccgatggcaatcgtcaaatagctacggttatttttttctaacatcggcaaccaagtatcaatgtaatgacgagtgagataaataaattcattgacttctgtatgactatttagaaattctgcgacaggggcttctaatccagtcattgggcgtaatgttggatcccaatgggggttaggtaaaaatcgtacatcgaaaacataatccgcatctaaaggaatcccatatttaaaaccaaaagattcaacaataatttttaattctttttcactattaccgcgtaaaaattcgcgtaatcgctctgcaagactatgcgtagaaagatgggtggtatcaagaataagatttgcgtgttgaatcaatggttcaagatagcgatattcttcatcaattgcggcttcaagagataaatcttttaatgaaagcgggtgcaaacggcgtgaatcgctatatcggcgaatcagggtggcacgatcagcctctaagaaaatgattttaatctgatgatgcttttgtaatgttgaaagggtttgcttaagagaatgagcggagtttggaatattacgaatatcaagactgatggcgacagatgattgggattgagatagaatatcagtcaattgaggaagtaaatccagaggaatattatcaacacaataatatccggcatcttctaatgctcgtaaggctacagattttcctgcgccagaacgtccactaataatgataatttccataagtttccccactgtaattattctttcacttcttcaaatgtcgtttctgattgatcggtaatttcaaaaacttgccaaatttcatccgcacttttggctgatcgtaattgtttcaacacatttttatcagtcagtttttctattaatgatgctaaaactggaatgtaggtttcacattgattttctggaattagcaaggcaaagattaaatccactggtttaccatcaaaagcatcgtaatcaatcggattatcgagttgcataaacactgcgattgctttatctgatactgttacggggattttcgcttttggcattgcaatcccatttcctaaaccagaattccccagtttttcacgttcaaaaaggcattcaaaacaggcttgttcgcctttttctgcaaggatttgttcttctacaaaatgcgcaatagactcaaataatcgttttttgctagaaaaactaacgccctgacgaatattttcagggcttaatagttcagttattttcatttttataatttgaattgttcgccaagataaacgcgtttaacctgttcatcgttcatcacttgttctggtgtgcctgttgcgataattttacctgcgccaacaatataagcgcgttcgcaaacatcaagggtttcacgaacattatggtcagtaattaatacacctaatccacgattgcgcaaatcagtaataattttcttaatatcgctcacagaaataggatctacaccagcaaaaggttcgtctaatagaataaattttggatttgctgctaaggcacgtgcgatttctacacggcgacgttctccgcctgataaggcttgccctaaattatctcgaatatgactaatgttaaattcttcaattaattcatctgctttttcgcgacgttgttgtggggttaaatctttacgaatttccaataccgccatcaaattttcatagacagtcaaacggcgaaaaatcgaggcttcttgcggtaaataaccaatgccacgttgcgcacgattatgcattgggagcaaactaatatcttcgccatcaataacaattttaccttgatcttggcgaacaagcccaacgaccatatagaaagttgttgttttacctgcaccgtttggcccgagtaaaccaacaatttcattagaatttacggttaaactaacatccgaaacaactttacgacttttgtagcttttagctaaattctctgcagtcaaaattgacatagattacttccctttagcttgttgtaattgagatggaataagaactgttgttactcgtgattttccattaccattagctttaagttgttgttttttcacatcataggtaataacactgccattaattttactatcaagctgctttaattcggcattgttagttaatgttaaaaattcgttaccaagatcataatgaactttatttgcttttccatccactggcttaccattatctaactgttgatggaatgtgactggcgtgccgaatgcttctacggtttcttttttccctgatttttcagcaggacgagtgatgacaactttatttgctttgataacaatagacccctgtgtaattaccacattatctgtgaatgtcactacacttttttccatatctaaggattgattatccgaaacaatatttatcggctgattaacatcatctttcaatgcaaaagctgaacttgatgctaataccatcgttgcaagaaaaagaattttattgcttactaacttcataatatgtttttacctgttcctttaatgtcgccacttgttggcgtaaatttccgactaattttaatcctgtagaactaaaatttttacccttaattttaacctgtgtttcggaagttatatcctgtgttttcaaattgacgaccgctgattctgtttcaatgcgttgcaaacgtgaatctgatgttaaattttgcgcgacgacattaccctctaaatacaatatttgatcttttgtcaatcttgcttgatttgcgcttaatttccagctttgtgtgctaaaaaaatctacattttgattggcatttttttccttttccttttcatttgatgttgtgggatataaataaactaaaggcgcggtaaaaagggtttgttcattgactgtataatgctcaattttatcggataaagccaaatattgttttttaccatcaggggaaaaaaccgtagtttccattttataacccacataatcaggactatctggctttttcacaagttcagataaatctgcggtttcctgatttaaggaataaaaccacgccaaagcacaaagtgcgataacgcccaaaattacattccaacgaatattcatttttatttcaatcacttatccacaaagtgcggatgaaaatttcaatgtttttaatcttccaacattaataccttgagcatttgataaatttctcgataggctttcgatggtttattttgctccagttctttttgtgcagaacgaatcagattgcgtagttgctgacgatcgccattaggataatcatttaataaatctgttaaagccacatcgcctttttccaccaattcatcccgcactttttcgattttatgtagcatagcttgttgttggttatgcttattttcaattttatctaaggcttcacgaatgggctcaacatcaattcctcgaaataatttgccgatatactgtaattgacggcggcgagcttctttttgtaaacgctgtgcaagttcaatggcatcaagtaaggattcatcaagtgggattttggcaagattagctttggttaaattgacaatcttttcgccaagttgttttaaatcttccgcatcgcgtttgatttcgcttttactcacccaaataatttcttcttgatcttcatcttcccaatcgaaaacttcttttttcttacgttttgccattttttatcctttataaaaattggcgtgcattttaccataaactttaaaaataagataaaatgttgaaaatttttaataggaaaaaataatgaaaccagctgaaaattcaaccgcacttttaaaagcacaagaacaagaattacgtcaagccgtcagttttgcagtggagttagcaacgaaagctggcgcaagtgcagaagtcgcggtcacaaaagtgagcggtttatccgtatctgctcgtttgcaagaaattgaaaacgtagaatttactaatgatggcgcattggggatctccgtttatatggggcaacaaaaaggcaatgcttctacttccgatctaagcgaaagcgcaattaaaaatgcggtagaagccgcacttgcaattgcaaaatacacttcacccgatgattgcacagggttggctgataaagatctaatggcttttgatgcgcctgatttagaactttatcatgctgctgatatagatgttgataaagcgacggaattggcacttcaagcagaacaagccgctttgcaagcggatgaacgcattataaatagtaatggtgcaagttttaattcacatacaggcgtgaaagtttatggaaatagccatggcatgttgcaaagttatttatcaagccgttattccttatcttgttcggttattggtggcgtagaagatgccttagaaaatgattacgaatacacgatctctcgtgaattcgataaactccaatcgccaatttgggttggcgaaaattgtgcaaagaaagtcgtttctcgtttaaatcctcaaaaattgagtacacgagaagtgcctgtcattttcttaaatgatgttgcaactggtattatttctcattttgccgctgcaataagtggtggcagcttatatagaaaatcaagtttcttactcgatcatttaggtaaacaggtcttaccagattggtttagcatcagtgagagaccacatttattacgtcgtttggcttctacgccttttgatagtgaaggtgttcgcacgcaagatcgtgaaattgtcgaaaacggcatattacaaacttatttagtgacaagttacagtggtaaaaaacttggtatgtcaagtacaggtcatgctggaggcattcacaactggcttgttaagccaaatttaacgggtggattgaccgcacttttacgtcaaatgggaacaggcttactcgtaacagatgttatggggcaaggtgtcaatattgttactggcgattattcccgtggcgcatcaggtttttgggtggaaaatggggaaattcaatatcccgtcgccgaaattactattgcgggacaattgcaagatatgttgaagaatatgcttgctgtagcggatgatatagagcatcgttctaacatccaaacgggttctattttgttagataaaatgaaaatttcaggaaattaagaatatttttgaaattgagaataattcttattgacaatgaatgaatatctgttactatacgcacatctgttaagcgattgcaggttgctccaacaggtagagtagaaagtaaattcgttagggttcaaaaaggctgaaggtttaaacttcagccttttttttgtaaaatagcaaacgattttatcccctgtcatttcataaggaaacacaatgaaaaaacaccacgtagatgttttaatttcagagaacgatgttcatgctcgtattgctgaattaggtgctcaaattacaaaattttatcaagaaaaacagatcgataaccttgttgtcgtagggcttttacgtggttcctttatgtttatggcggatatcgttcgtcagataaatttacctgtggaaattgaatttatgaccacttcaagttatggcactggtatgaccacgaatcacgacgttcgtattaccaaagatttggacggcgatataaaaggtaaacacgttttaattgtggaagatattattgatacgggctatacgttggaaaaagtgcgtgatattttgaatttacgtgagcctgcgagccttacaatttgtacgttacttgataaaccctctcgtcgcgaagtggaagtgcctgttgaatgggttggttttgaaattcctgatgaatttgttgtggggtatggtatcgattacgcgcaacgccatcgtaatttaggctatatcggtaaagttgttttagaagaataatttgattttattgaaaagtgcggttgaaattttaaatgaatttttagccgcacttttttatattatttcattgctattttctcgatcacttgctaaatctttttacagcaaatacagccgttatattgataatcttgctggggcaattttcttatttttcggcggctatttagtttattcgggcgtgctagccactgcagccgcattttaattaccaaaaagcataaaatataacgaaagaaaacttgttatttttgctgaagttgatagtctccaaacactttaatcagttttggagattttttatgttattagtcaatttggcgatatttattgcttttttattgctgttagcacagctatatcgcaaaaccgaaaaattagggcaaacggtatttatcggtttattgctcggtttgctttttggtgcggtattgcaatctgcttttgaaaaacctttgttagacaaaactttagattggatcaacgtggtcagtaacggttatgttcgtttattgcagatgatcgtgatgccgttggtgttcgtgtcgattttatctgctatcgctcgtatcaatcaaaccagatcattgggcaaagtcagcgttggcgtgttatccaccttgctgattaccaccgccatttccgctgcaattgggattgcgatggtgcatttatttgatgtgtcggcggcaggattaatcgtgggcgatcgtgaattagcggctcaaggcaaagtgttagataaagcagggcaagtgtccaatttaactgtgcctgcgatgttggtgtcctttattccgaaaaatccttttgctgatctcacgggtgccaacccaacgtccattattagtgtcgtaattttctcagcattacttggcgtggcggctttgagtttaggcaaagaagatcaagcacttggcgaacgaattgcacaaggtgtagaaactttaaacaaattagtgatgcgtttggtgcgttttgtgattcgcttaaccccttacggcgtgtttgcgttgatgattaaaatggctgccacctcaaaatgggcggatattgtcaatttgggcaattttattgtggcttcttacgctgctattgccttaatgtttgtggttcacggcattttattgttcttcgttaaagtcaatcctgtggattactacaaaaaagtgttgccaaccttaagttttgcgtttacatctcgctcaagtgcggcaacaattccgttaaatattgaaacgcaaaccgcaaaattaggtaacaacaatgtcatcgccaactttgctgccacattcggtgccactatcggacaaaacggctgtggcggcatttatccagcgatgcttgctgtaatggtcgccccaatggtcggcattgacccttttagtttcagctacattctaaccttaattttcgtggtcgccatttcttcattcggcatcgcaggcgtaggtggcggagccacattcgccgctatcgtcgtgctatctacgttaggtttaccactggaattaatcggtttactcatttccatcgaaccgatcatcgatatgggacgtaccgcacttaacgtaaacggtgccatggtggcaggcacgattacggatcgcttgctaaataagtaactggaaatcaataaaaaaatctgcaattgagaattcagttgcagattttttatcgctcaatacttttgactaaaaagtgcggtggtttttttcagtgttttataacttaaatcgatgaataatttggtttgcggaacctcgccaaactaaacttgggtctgcctgttcttgaataaatttcccatcaattaacacatcaatataaggcaacattgcacgttgttgtttgtctaattcatctagcttataacccgtccaaacccagatgtctttatcgggacattctcgttttacacgttgcacaaagggcaataatgtttctacgttgaggggatgaagtggatcgccacctgaaagcgtcagaccttggcgtttaatgcgtgtgtcttttaaatcattgatgatttgttgttccattacgtcatcaaataatacacccgctgaaaatgaccaacttttttggttgtagcaacctttgcaagcgtgcgtacagccactgacgaaaagtgtgcatcttgtaccttcgccattgataacatcggtcgggtagtattggaggtagttcatttcataagaatcctaaaaatgtggcttaaattctcgccaaattcaccgcacttttgaattagtctttgcaatacggcggtaatttctgcataatagtgcacaatcgcattgcgatatcaatggaaaccttctcggtctctcgcaacggtgtctggtttactcggtcaggtccggaaggaagcagccaaagtcggaattactgtgtgccgagaagaagctgggaaggtttccgcccaacttccttttcttatactcgctcaatcaatcttttaaagaacccattttcttttgtgattaaactattgtaatcgccttcttcgattaatcttccgttatcaattacacaaattttatcgaattgttcaattgaactgagacggtgagtgactataattagggttttattttcggcatgttgcagaattaaacgtaaaatttgacgttcagtttcgcgatctaagccttctgtcggttcatccaataataaaattgacgcattattgagtaaaatacgcgctaaacctaaacggcgttgttccccgccagaaagtgggcgaccaccatccccaagccaaagatttaaaccctttccctcttgctcaagtaatttacttaagccaacttgatgtagcatttcaatcatttgttcatcagaaattttatccgcacttgcaaattgtaaattttgacgaagtgtatcgctaaatacatgaacacgttgagttaaaaaacaaatttggtggcgtaatgtttcttctgaataggcggaaatgggtttttctgccaataaaagctcaccttgattcgcatcataattgcgtactaaaagttgaagaagtgaagattttccacttccagttttgcctaaaatagcaatttttttgccctgttctaaatctaatgtcagattttttaatacaagcgtttcttgttcgggataggaaaaatttaaattcttcgcagaaattaaccgcacttttgtttcaaattcctcgttgccattaaactcaacaagcggtttttgctcaatgatttcggtcacacgctctgctgctgcaatcacttgacctatatgtaaaaatgccgcacccaatggcatgatgatctcaaaggcggcaagtgcagcaaaagtgaaaagtgcaatataagccgtgtgatattcatctgtgccaaaatcggcgttacttgcaaaccatagcattccagaaatcaacaaaccattaagaaagagaacaagtgcggtagagaatccgcttaattttgcttctttagcttgatcttcctgccatgttttttctgtgactaacattttctcttttaatttatcttctgcattaaataataaaagctcagcttgtgcttggataaattctaaaaactgggttcgataggtcgcgcgtgcttggattaagcgttcaccaaattgctgtcctagtcgatagaaaacagttgggataatcattaataaaattaacaaaaataagcctaaaccaagtgcgagtggaatattgataaagctaagtccaatcatcatggcaatgattacaaatacagcagtgaaaaatggcgcaagtaaacgtaaatagaggctatcaagtgtatccacatcggaaactaaacgatttaataaatcgctgttgcgataacgatttaacacagctggacttaaaggaatgattttttcaaatacttgcacgcgcaatttggacaaaatgcggaatgttgcatcatgcgtcactattttttcaaaatagcgcatgacggttcgtccgatagctaaacctcgcacactggctgaaggatagaaaaagttaaatagcgtgcctagtcctgcaatggctgtagcggctaaaaaccagcctgaaacggtaagcaagcccatactagagcccaaacctagaatcattagcaccaagcctaaaataagcgggaatttggcgaatttaaataaacgtataaacggaagtaatgtgcgcattattggatatcctgttgtcgttgagcgagtagttcagcaaagaaaccttcatgttgtaattcggtaaatttaccttgctgtactatttctcctcgttgcatcacaaaaatttgatcacattgtttcaaatcttcaattcggtgggtaatcatcagcgtagtttgatgctggcttgcttcattcaatgcttgtaaaacaagattttctgattgcgcatctaggcttgcggttggctcatcgagcagaagtaaatcgcctttgcgtaacaatgcccgagcaatggcaaggcgttgcgcttgtcccacagaaatgcctaatccaccatcttttatttcgtgatgaagtccaagtttatcggtaaattctttcgcttgagaacgcattaatgcttgattaatttcttcatcgttggcttgaacatcgccaagtagtaagttttctttaattgtgccttgtaataacaatggattttgtcctacccacgcaatatgtttgcgccagtcagctagattactttcgcgaagttcttgcccattaattttaagagaaccctcataaggtaaaaagcccaaaattacattcattaatgaggttttccctgcgccactttgtcctacaagtgcaacattgtgatttgctggaatttggaagtttaacggcttggttaatgctgaaccctgtgtcgaaagcaccactaaattttcggcagaaatttcaaccgcactttctaaagaaattgttttttcattttgatgtacagttaaataatcggattctaaaaaatcaacaatggcatctgcggcaccaatacctgctgcgcggtcgtggtaataagtgcctagatcgcgtaagggttgataaaattcaggtgcaagaattaaacaaaagaaacctgtgaaaagtgtaagcggtgcattataggtaccaaattcaatttgacctaagtagctaaaaccaaaatagaccgccatcagtgcaatggaaatagaggtaaaaaattccaatactgcagaagagagaaaagcgagttttagcacatccattgtggtttcacggaaatcttcagtggcattttcaatatgctccgtttgttcagaagtgcggttaaaaagacgcaaggtttccaaaccacgtaagcgatctaaaaattgggcactgaggcgagaaagggtatccatatttttttggctgttgtcagccgcagcaataccgacaatgatcataaacagaggaacaagcggtgcggtaatcattaagattaagcctgcagcccagttcaagggaaatacagcaatgaaaataaccactggaacaatggctgaaagactttgttgaggcagaaaacgggcatagaaattatgtaagttttcaacttgttccaacataatgcttgcccaacttccagctggtttttgattgattgtcgcagggccgacaagatggattttatccagaattttttgacgaatatggttgcgtaataattgtccgctttggaaacctattttttcgcgtgcccataaaataatagcacgcatcccgaagccgataattagcccgagnaaataaggaataagttcatcacgaggcacattttgcataatcagtttatcgagcaacgtcgcaagaaaataagtttgtgcgactaaaatgaatgaagaaagcgtagctaagacaatgtttgcacgcattaattttttgataggttcttgttgtgcgcgaagccatttttgtaaatatttttggcgaagtttattcattgttttggtcgtgattatagaaaaagttcccctctttaaaagagttaaaagaggggaattggttagaagatttatgcttcttgagcatctaaatagcgttctgcatccaaggctgccatacaaccagttcctgcggaggtaatggcttggcgataattgtgatccatgacatcgcctgctgcgaacacgccttccacagaagtggcagttgcattgccgtcaagaccagattttacaacgatatagccattattcaattctagttgcccttggaaaatttccgtatttggcgaatgaccaatcgccacgaataagccatctaatttgagttcttctttctccccagtttttgtgttggctaaacgtaatccagttacgcccatattatcgcccaatacttcatctaaagtgcggtcagtatgaagaacgattttcccttcttccacttttttgtataaacgatcgataaggattttttccgcacggaagctatcgcgacggtggattaaatgcactgtacttgcaatattggctaagtaaagggcttcttccaccgctgtatttcctccaccaatgacaccaacaggcttattacgataaaagaaaccatcacaggttgcacaagcagaaacgccacgacctttgtagttttcttctgaaggtaagccaatatagcgtgcagaggcacctgttgcgataattaacgcatcacaagtgaaattttgcacatcgccaaaaagtttgaatgggcgagaagataaatcgacgcgattgatatgatcgaaaacgatttctgtctcaaatttttctgcatgttgcaacatacgttgcattaaacctgaaccagtagtcatctcaaaatcgcccggccagttctcaatttcatctgtagtggtcagctgcccaccttgttgcaaaccagtcaccaatactggttttaagtttgcacgtgccgcataaatggctgctgtataaccagcagggcctgagcctaaaattaaaagttttgcgtgtttgatatctgacataaagaatccttgtttgtagttaagtaataatataatgcaataagttgcattttactgattataaactttttgcttagtaaagcagcgaataaagcaatcgacgaaatttatttgtcagcggatcagcattgcccattgcgcttaaaatagataaaaattgttgtttaacttcaccattctgcgcgcctaaatctgtttttaaaatgccgaaaagtagtgttaatgcttcttcatttcgtccagcttgatgaagttgtacggcaagttttattgcaatttcagctgttgggtttttagcataatcagcctgtaattgttggatttcaggtgtatcggctgcttgaatttgtagctcaatttgtgcttgtaatccgtgccaacggctgtctcgatcttgcaatggaatttgatttaaaatttcttgtgctggctccgtttttttcattgcaatataggtttctgcgtagagtagagcaacatcactatttttcttatctgaaagttcccacgcatctttcaataatggcaatgcagcttcgtaattttctacttgtaagaaatctaatgcttgttggaattttaaatcttcctctttaggtaaaataatgcttaatcgttggattaatgaagatttatcaagcacgcttggaaatgcatctaatgcctgtgcttctttaaacaaataggtggttggcaatgcttggatgcggaattgtgcggcaatcattcgctctttttcacaatttacttttccaagaataaattgtccttgatattgttctgcaacttgctcaagtagtgccaaaaaatccgccgattctttatgcgttggcgcgtaaaaattgatgacaagtggtttttcctaaggattgttgcagtatttcagtaagattttgttcgttgatctcaacgataaaaggaaaatcagccatgttttatccttgtgaaaaaaataatggctgattttagcaaagtgcggaagattttagaaacgttttaccatttctattattaagtaagtttttctaggatcaattttcccatcatttcaatatgtgcatgctctacattaagtgcaggaatatattgataagattgtccgccattgtttaggaaattttctcgattttcttcgtcaatttcttcaatggtttctaaacaatctacggagaaacccgggcaaataacggcaattttttgaatgttctgtgctgcagcagattctaaaaatttatcggtataaggttgcagccattcttcacggccaaagcgagattgaaacgtcattctccattggttttctgttaagcccagcttattaacaactgcaatagtcgtttgtttacaatgttcacgataataatcgcccattttttcgtaacgcagaggaataccgtgataagaaaataacaaaaactcatcggattttaaccgcacttttatggagtcggctaaggcattaatgtaattttcatcaatatgataagaatggatgaaatcaaaaggcagtaatcctcgttcttctttaagagcgttagcgaaagcatcaaatactgcgcctgtagttgagctagagtattgcggataaagaggcaagacaataattcgctcaacttgatttttaagcaaatttttcaccgcactttgcattgatggattgccataagtcatggcaatttctacttgagtatcgatattttgattatctaaataggcttgtaatgcgtctttttgttgtcgtgaaatagcaagtaaaggcgatccttgctctgtccaaatggcttgataatttttggcgatacgttttgaacgcaatggcaaaataatggctttgagtagaggataccatttgcaacggggtaaatcgaccacgcgaggatccgttaagaattgccataaataacggctaattgactttggcgttgggctatctggcgtgcctagattggcaagtaatacgccgatttttgctggttttgtcataaattgattacggaaagggttaatctagaaacacaacaaagtttattctcttctgtgcggatgtcaatttgccaaacttggatatttctgcccaaattaattggcgtggctcttgcagttactttacctgaacgcacagggcgaagatgattggcgttaatatctaatcccaccacagttttgccttcttccaaacaaagcgaacccgcaagagaaccaattgtttcagctaaagcaaccgaaaccccaccgtgcaacacaccaaacggctgcatagtacgatgatccactggcatcgtcgcttcaatccaatcctcgccaaaagctgaaatttcaatgccaagatgactcactgcactgttggagcaaagttgatttaagttttcaagggtaaaagtttttttccagagcatttaatctattccatattatcaattatcttggctccacccatttatggggggagctgccgaaggtgaggggggataaatgttcaatttcaacctaaattgttttaggtacattatctatgttttttaatatttcatcactccaaaattttatttcgcatatccctatatcccccttcccttcgggcaccttcccccacaagcaggggaaggcaagtttttaaaacctctaataagcagaaggcaagttatcattatttattttagaacctctaatcttggctccacccatttatggggggagctgccgaaggtgaggggggataaatgttgaatttcaacataaattgtttcaagcacattcttcttcccttcaggcaccttcccccgcaagcaggggaaggtaagtttttttaaaacctctaataagcagaaggcaagttatcattatttattttagaacctctaatcttggctccacccatttatggggggagctgccgaagtgagggggggataaatgctcaatttcaacataaattgcctcaagtacattatctatgttttttagtacttcatcattccaaaagcgaataactttatagccttgtgctgttaagaattttgttctttctaaatcatattgttcttgttctacgtgctgaatgccatctaattcaataacaagttttaattttctactgcaaaaatccacaatgtaatgaccaataataacctgtctattaaaacggataccgcaaaagagtttatttctcaaatggtaccatagtgcatattctgcatctgtcatattacgtcttaattctgtagcatattgggctaatcgtttatttttatttcgcatccctatatcccccttccttcgggcaccttcccccgcaagcaggggaaggcaagttatcattatttattttaaaacctcaagtaacgcctgcacaggatgcttcaacactacatgttcataacgttttacttgactgcggcaagaataaccggttgctaaacaaaagtgcggatcttttccatgtagttttttatgccatgatacatcgtagatttctcggctcattttttgattttgcacttcatgtccaaatacaccagccataccgcaacagcctactttttctacattcagttgttgtccaaatcttccaaaaatttcttgccattcttttggactattcggcataaaagtagattccgtacaatgagggaataaataccaacctaaagtgcggtcagttttggcgatgttttttaacttctcttgcaaatccgcattttgtaatctttgttttaaccattcgtgagcagtgagaacgtgaaaatcgccccgtttttcttgtagtgcttccttgtattcatctcgataagatagcacgatggctggatcaacgcctacaagtggaatgcctaattttgccattcgatttaaaaactcggcttggttttgtgctgttttgctaaagcgttttaagaaacctttaatgtgcattgctttgccgtttggtttaaatggtaacaaaattggtttaaagcctaatttctgcgtaagcataacaaaatcgcgaatcactttggcatcatagtaagaggtataaggatcttgcacaataaataaaatatcgtttttttctaccgcacttaggctttccaattcttctaaggatttgccttgataatgaatttctaccagctgttgttgcaaactgggttcagaaagcaagggcaaatcggtcatgcctagcgttttttccactaatgtttgcgtgacttttagcttggtaaaataattaaagaattttgcctgttttgccatataaggcgcagcgatttctaaatttgccacaatgtgatcttttgtggggcgtaagtagcggctgtgataaaaatgaaagaatttcgcgcggaaacttggtacatcaattttaatcggacattgactcgcacaggctttacaagcaaggcaagtatccattgcggctttcacttcgtgagaaaaatcataattgcctcgccatttttgaaccgtattgcttagtcgtttcacaagtgcggttagttttatttctgttttacggaagtctaattgttcgggcgaaacattttcatttgccatcaatcgaagccattctcgcaccatcgcagcgcgacctttcggcgaaaatacacggtttttactgactttcattgatggacacataatgctgtgttcatcaaaattgaaacataatccgtttccattgcagttcatcgcccccttaaattcatctcgtatttggataggaatttgacgatccttatcagctcgcatcggcgaaagaatagaataaagttcatctttggaatctaaaggcgtacagattttgccgggatttaagcgattgtttggatcgaataaggttttgatataacgaagttcgtgccagagntctggcgtaaagaatttttcgccgtaatgggaangcacgccttttccgtgttctccccaaagtaatccaccatatttaatcgtaagttctgctacttcatctgaaatttgtttaaataatttcacttgttctttatcgcataaatcaagcgcagggcgaacgtgcaacacgcccgcatcgacgtgaccaaacatgccatattgtaaattgtgctggtctaataaagcacgaaattcactgatgtagtccgcaagattttctgggggaacacaagtatcctccacgaaaggaattggtttggctgcaccttttgcattacccagtaagcccactgctttttttcgcattgcataaattcgctcgatagacggtaaatcagaacagacttgatagccaataatgtgatcttgattgtgttcaattttttcatcaagtaagcgacaaagtgcggtgacttggcggtctattttttctttattattaccagcaaattccacaatatttaaaccgagaattggatctttttcatcttctgtaagaagttcattcacagagtgccaaataatatcttgtttggcgaggtttaagactttggaatcaacggtttccacagaaagcgcattggctttcaccataaaaggtgcattgcgtaatgctgcatcaaaagaacgatatttaatattgatgagcgtgcgatactgcggaattagcagaagattgagtttggcttcacaaataaatgcaagagaaccttcagagccagtgagaattctggtgagattaaattcactttcatcttcattgaatacatttttcagatcgtatcccgttaaaaaacggttaagttgtggcagatctttaatgatagccgctcttttttctttacaatgttgcgcaatggtttggtggagctttttgctactctcacttaattcaagcgcatcaatgttttctaaaacatcaacagaattgaccgcacttgtatctaaaatttcgccatttattaagactgcgcgtaatgccaaaacatgattagaggttttaccatattgcaatgagccttgcccagaggcatcggtgttaatcattccacctaaagtcgctcgattgctggtggacagttctggggcaaagaacaaaccatgtggttttaaaaattgattaagttgatcttttactacgcctgcttgtactcgaacccaacgttcttttacattgagttctaagatggctgtcatatgacgagaaagatccactattatattgttattgatggattgcccatttgtgccagtgcctccaccgcgaggcgtaaagctgattgattgatattcaggtaaatttgccaattttgttatccgcactatatcagcaaccgttttcggaaaaagaattgcttgtggaagttgttggtaaacgctgttatccgtagccagacttaatctatctgcatagtttgtcgcaatatccccctcaaaatgttggcattgaagatcatcaagataatcaagtacatattgttcaacttgaggaatgcgatttagatttggcaacatagtatttgacccatttaaacatatcagatggaggctttgataatatcctaaggctagaataatgtcgattaggaaagagagaggagaaagtaaaaagtctgtttaagaaagtgttattttggataaaaactaaacaaaaaattcaaaagaatttgatcttttcaatttttataggataataagcgcacttttgaacgttcctttggggtaaacataagcaaaggaattgaatttgtcaaaaggtaataaagtagggcaaattcaaaaccctagttaagtgactgtttataatgtagctttaattaaaagttcagtataaacaaggacactttttattactattcgatcactaaatagaggacatcaaaatgaaaaaaactgcaatcgcattagtagttgctggtttagcagcagcttcagtagctcaagcagctccacaagaaaacactttctacgctggcgttaaagctggtcaagcatcttttcacgatggacttcgtgctctagctcgtgaatataaagtaggttatcaccgtaattctttcacttatggtgtattcggtggttatcaaattttaaatcaaaataacttaggtttagcggttgaattaggttacgacgatttcggtcgtgccaaaggtcgtgaaaaaggtaaaactgttgttaaacacactaaccacggtactcacttaagcttaaaaggtagctacgaagtattagaaggtttagatgtttatggtaaagcaggtgttgctttagttcgttctgactataaattatacaatgaaaatagtagtactcttaaaaaactaggcgaacatcacagagcacgtgcctctggtttatttgcagtaggtgcagaatacgcagtattaccagaattagcagttcgtttagaataccaatggctaactcgcgtaggtaaataccgccctcaagataaaccaaataccgcacttaactacaacccttggattggttctatcaatgcgggtatttcttaccgttttggtcaaggcgcagcaccagttgttgcagcacctgaagttgtaagcaaaactttcagcttaaactctgatgtaactttcgcatttggtaaagcaaacttaaaacctcaagcacaagcaacattagacagcatctatggcgaaatgtcacaagttaaaagtgcaaaagtagctgttgctggttacactgaccgtattggttctgacgcgttcaacgtaaaactttctcaagaacgtgcagattcagtagctaactactttgttgctaaaggtgttgcagcagacgcaatctctgcaactggctacggtaaagcaaacccagtaactggtgcaacttgtgaccaagttaagggtcgtaaagcgcttatcgcttgttttgctccagaccgtcgtgtagaaatcgcggtaaacggtactaaataattttagtatttgtttaacgaaagattaaatacagcaaaaggcttaaacttcggtttaggccttttgttttaaatgaatataaaaccaagcatttcaatcaagttttaacttgtgataaaatgcttatctcgtttatttatagggaacattatggaaaccttagacaaaatcaaaaagcaaattagtgaaaatcccattcttatttatatgaaaggttcgccaaaattaccatcttgtggttttcctgctcgtgcatctgaggcattaatgcactgcaaagtgccctttggttatgtggatattttacaacatccagatattcgcgctgaattaccaacatatgcaaattggccaactttcccacaattatgggttgagggagaattaattggtggttgtgatattattttagaaatgtatcaagcaggcgaattgcaaactttattagctgaagtggcagcaaagcacgcttaataacagtggaaaaataaaacccgcaataagcgggttttttatataataaatttccctttcattattaaataatagattaagcaaactttaataccttagaaagtgcggtgaaaaatttatcgttttcttcaggtaaaccaatacttatacgtaaatgattcggcatgccataaccagcaattgggcgaacgattacgccttctcgtaacaacgcatcataaattggtgcggcaggttgtttgaaatcaatggttataaaatttcctttagagggaatataatccaattgatttttttgacaaaagtcttcataacgtcgcatttctattcgattattttcagcaactttttcaacaaatttatcgtcattcattacggcaacagcagcggttaatgccaaagaattacagttaaatggctgtcgaactcgatttaataaatctgcgatttcgggattagataccgcataaccaatgcgtaagcctgccaagccataggctttggaaagagaacgtgaaataattaaatttgaatatttttttaataaactgaaagagtccactcgttcttcagatctagtaaattctgtgtaggcttcatctaataccacgattacattttcggggacttctgctaaaaaatcttcaatttcttgcgaggttaaaaaattacccgttggattattgggattagcaatgtaaatgagctttgttttatcagaaagtgcggtcaaaaatccttgtaaatcgtgcccccaatttttagctggaatttcttttacaattgcattaatcgctttagttactaaaggatacacaataaaggcatattgtgaatacatgatttcatcgccttccgttgcgaaagtgtgagcaaaaagttctaataaatcatttgagccatttccaagcgtaatttgatttggttgaacgccaaatttttttgcgatagtttgttttaattcaaagccattcgcatctggataacgagttagtttatctaattgttcgaaaattgctttttttgcactttctggaaaaccaaatgggttttcgtttgaggcaagtttaacgatattggaaataccaagttctcgttccaattcttcaataggtttgcctgcttgataaggggataaggattttacgccacgattggcaatgttgatgtactgcatagttgtatttataaatattgatatgggttagtatgtatttttaaataaatttgggcgtagtaaatacgcccattggaaatgtttttcctattgaggaagattttcagtttcaaattttttcataaatgaaatgagtgcctcaacaccattttgcgacattgcgttataaatagatgcgcgcattccacctaaaaccttatgacctttcaaggcttgcaagccagcagcagtagactctgcgacaaattttgcatctaattcaggattacctgtgatgaaagtgacattcattgttgagcggttttcttttgctaccacattgcgataaagtttgctcgaatcaatataatcataaagggtttgtgcttttagtgcattacgtttttcgattatttctaagccgcctatttctttaagatgtttaaatacgagggaacataaataccacgcaaaagttgggggcgtgttgatcattgaatctgcatcacgttgagttgcataattccaaatagatggggtttctttacgtgcattaccgattaaatcatcacgaataatgactaatgtaatgcccgcagggccaagatttttttgcgcaccagcataaattaccccaaatttactgatatcgatttgacgtgaaagaatatttgaagacatatccgcgaccaatacggcattgcccacatttggcacatcaaaaatctccacaccactgatggtttcattcgggcaataatgaacgtagtcatattgatcagcgatatggctaaaatcaagatcggtaattcgagtctgttcgccattttctacgatagtgatttcatcaatttctgcaaaatttcttgcttcttttgccgctgtagctgaccaatgcccactatttaaataaagggctttgccttttttaccgattaagttcatcggaatggtggcaaattgaccgcgagcaccaccttgtaagaaaagtgtacgatagttatcaggaatattgtaaacctcacgtagatctttttccgcttgggtaacgagttccataaaatactttccgcgatggcttacttccattacagaaacaccttgattgagccagtttataagttcattttgtgctttttgcaacacttctgggaaaatcatcgcagggcctgcgctaaaattaaagacttgtgacattgtatttccttgctttttatgaaaataatgatgtcttttttatcactacaaaaatcgataatcaatgctttttactgaaatcaaaaaaattctttctatcattcataaaatagagggtaaattttgacgattgattaaaaaaaagctaaattacggcacagtcattttatttattttaaagggagttgttatggaaattgtgaataaacaatcttttcaagatgtgttggaatacgtgcgtatgtatcgtttaaaaaatagaattaaacgagatatggaagacaataatcgtaagattcgcgataaccaaaaacgcatattgttgttggataatttaaatcaatatattcgtgatgatatgactattgcagaagtacgcggaattattgaaagtatgcgtgatgattatgaaagccgtgtggatgattacacaattcgtaatgctgaactttctaagcaacgccgtgaagcgagtacgaaaatgaaagaacagaaaaaagcacacgcagaattattgaaaaatgctgaaaaataataggataactagagccgactgaatcagtcggctctattttttataagccattcattgcgttaatgattttaatttcgtcaaaattgacaatatcttcttggaatattgtgcgttcttgaattttcccttcttgtaataatttttctcgttgtgtgcctaaaagcaatggcgtgtctggcgtgtaccatttttttccttggcgaaaaattaaattaccgatggaacaatctgtcacttttccatttttgataatcataatttcatcacaagcaccacgttgagcaaataatgtattaattaaactgcgatctgaatatttcaaactatattcaatgtcatcacaaattacaggttgaaaagtgcggtagatttttcgttggtattcaaaatattgaatttgtgtggtttcggcattgtaatcaatgcggcagcgaattaattgattttgtaaaggcgttggaagttgaatgagtgaaaaaagattaaaaattttcaccgcacttttaccataatattcacgcaaactacgttcatatcgcacttggtgtaaattgatattttgaattttcccgttttcaatacaaagggtttcaaatagaggatacattaatccgcaccttcaatcggtaaatagactttttctaacaattcttcatattcatcttgtgcattgctatgaatggtaattccgcctccactatgaaaataaaatttttcatctacttgggaaataaatcgaattgctaccgcactttgtagtgttttgccatcaaatatgccaaaaattcctgtgtaataaccgcgcttttgtttttctgcttgttgaataatttgtgtggttttttcttttggggcgccactaatagacccngcaggcaagagtgtcgctaaaatatccccaatttgattttgccagttttcattcaattttccgtaaatttcagaactggtttgcagtattttgcctttctgggtcttgatacgatcgatataacgaaattttttcacttgaatgtgttctgccaccatggataaatcgttacgcatcaaatcaacaatcgtgtaatgttcgcgttgttctttttcatttgtgagtaactgattttctgcatcgggcagggtggcattaattgtccctttcatgggataggtaaaaatattgttgtcatgaatattgacaaaacattcaggcgaaaagcaaacgaattgatcttgtaaccacaatttataaggtgcattggtttgatgaaaaatttgttcaagtgacagattacctgaaatttcagtggggtaggtgagatttaataaataagaattacctttttgtaattcactttgaacaagtttaaaaccttgttgataatgcgagaaaggcattggatgtttggtaaaattaagagggagaggccgtggagaaatcgtgcaatttcttttgcctaaaatatcaaaataaatgccttgttgtgcagaattttcgagaggacaaatcaagggtttttctttttcaaaatcaataagaaagaaaaatggcgtgcgttgtttgccataatgattagcctgttcaataaaatgttgcattgtgctttgtgccattttgcgtaaaatgacctgattataacgaataccgaactgttatgaaattactcatcattaataatcacgattcttttacttttaacttggtggatttaattcgaaaattaaatgtgccttatgatgttttaaacgtagaagatttgaaagaaaatacagcggaaaattatagccatatattgatttcgccagggcctgatataccacgcgcttatccacaacttttttccatgttggaaaaatattatcagcaaaaatctattttaggtgtgtgtttagggcatcaaaccttatgtgaattttttggtggtacattgtataacttagagaatgttcgtcacgggcagaaacgaacattaaaagtgcggtcaaattctccattgttttttgatcttccaactgaatttaatatcgggctatatcattcttggggcgtacaggaagaagattttcctgattgcctagaaatcaccgcactttgtgatgaagatgtagtgatggcgatgcaacataaatctttgccaatttatagtgtccagtttcatccagaatcttatatgtcagactttggcgagaaaattttgcgtaattggttggcgattcctcccacaactaacccataataccgcttgcttattaagcaaaaatgcgtattatagccgtctatacgtcaatacatccaaatttaaaagaagaagagagaaaatatgtctagttatttatttacatctgaatcagtctctgaagggcatccagataaaattgccgatcaaatttctgatgcggtacttgatgaaatcctaaaacaagatccaaaagcacgagtagcttgtgaaacttacgtaaaaactggtatggcattggttggtggtgaaattacaacatcagcatgggttgatattgagaatttaacccgtaaagtgatttgtgatattggttatgaacattctgaaatgggctttgatggtcattcttgtgcagtgcttaatgcgattggtaaacaatctgcagatattaatcaaggcgttgatcgtgaaaatccattagatcaaggcgcaggcgaccaaggtattatgtttggttatgccaccaatgaaacggatgtattaatgcctgcagccattacttatgcacatcgtttaatggaaaaacaatctgaagtgcgtaaaagcggtaaattagcatggttacgcccagatgcgaaaagccaagttactttaaaatatgaagataataaaattgttggtgtggatgcggttgtgctttctactcaacattctgaagaagttagccaaaaagatttacatgaaggtgtgatggaagaaattatcaaacctgtgttaccaagtgaatggctttctaaagaaacaaaattcttcattaacccgactggtcgttttgttatcggtgggccaatgggcgattgtggtttaactggccgtaaaatcatcgtggatacttacggtggtgccgctcgtcacggtggtggcgcattctcaggaaaagaaccatctaaagttgaccgttctgcggcttatgctgcacgttatgtcgcaaaaaatattgtggcagcaggtttagcagatcgttgtgaaatccaactttcttatgcgattggtgtggctgaaccaacatctatcatggtcgaaacctttggaactggaaaagttgcgaatgaattattagtgtcattagttcgtgagttttttgatttacgtccttatggcttaattaaaatgttagatttaatccaaccaatctatcgtgaaacggcagcttatggtcatttcggtcgtgaacaattcccttgggaaaaagtggatcgcgcagaagatttacgtattgcggcaggtttaaaataataggcttgaatttttagtttgaaaggattatattggaaagcaacaaggtttcttgttgccttagttggtttaggttgctaccaagctggggagctaaaggacagcaacaagaacccgataataatcattaatatgattttatcataaggctatctcctttcagagttgttaaacaaagctgatcgagattgagttactgcctgacccgccagtcaggcaataacgtacctgaccaaccactggttattctatcatataaaagccgcttatctagcggtttttgcttttaccgatgacatcaatatcacttattccattccgtcatttaaaaatggcaagtgcaacgcaaattgaatcagtctttgctgcttgcagaggcttattttaagcgaaaatttacaatgccagaggtaaattatgagttacgaggtataaaggcaggcgtggcttacctacaaaaaaatgaaataaaatttaaccgcactttattgcaagaaaatacggatgaatttattcgacaagtcgtgccacatgagcttgcgcatttgattgtgtatcaaatgtttggtcgcgtaaaaccacacgggaaagagtggcagcttgtaatgaatgaaatttttaagcttcctgcagacacttgccatcaatttgatataaaaaacgtgcaaggtaaaacctttgaatatcgttgtgcttgccaaacccattttctaactattcgtcggcataacaaaataatgaaagaaaacatcgaatatttgtgtaaaaaatgtaggggaaaattagtttttgtcgatgatgaagaataatttttgtgatatatttttccaatttattcaataaataaaggagttatccaatgaaaaaatctttattagcagttattgttgggtgcatttgcctttgcttctgttacaaatgcgaatatttatgctgagggcgatatcggtttatctcaaactaaagcaaacggtagtaacaatacaagagttggacctcgcgtatccgtgggttataaagtaggaaatacacgtgttgcgggtgattatactcatcatggaaaagttgatggcacaaaaattcaaggtttaggtgcatcagtattatatgattttnacacgaattctaaagtgcaaccttatgttggtgctcgtgtagcgactaatcaatttaaatacaccaatcgcgcagaacaaaagtttaaaagttcttctgatattaagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacggattctaatttttagaatataaaaatcttttttataaaacactttaatttaacggtgatcgtttaaaacaatcaccgttatttattttgggattatttcaatacgctaaaacccaaaacttaccccagttgcagcacccacaccgttattggtatcagcagagccagaaaggctaattaccatatttggtttaggcttataacgaactccagctgcaacagcagattgtcctcgataaagtccctgcagctacgccagtaatttggtgggttatgcctcttattttattccccactgaaaccgaacccgcagtgcctttccaagttgaaactaattcatttttagctgtttcataagatttagtcgcgttgtcaatcttagcttgatttggattagctgcggttttcaactgttccatattggcttttaacccattaacttcctcttgttttttcggaaaatcgtaaagaatattacgtaattctgtcaaatcagcataattttgacgctctgttttataagcattttccaatggcttaatatcaaaaatatgtgatcaagatcacaaaataaaaaatcccaacggagattgggatttaaaatcactaaaaattttaccgcactttatgctttgcttacttcaaaacgttcaaatgccaatacttttttctctaatttacgtagtaataatgttgcaatgcctgtgataattaaatagataccacccgcaatgccgtaaattgtgagtgcatcatattctgtaccatagagttggcgtgcgtaacccataatatccataatcgtaatggtggatgctaatgccgtgcctttaaataccaaaataatttcgttactgtaagaaggcaacgcacgttttaaggcataaggaattaaaatttttaaagtttgtatgcggtttaatcctaatgcgccacaactttcccattgtcctttgggaatggctttcactgcaccgtgaaataattgggtggaataggctgcactgtttagtgctaaagctaatgcagcacagaaccacgcattggataagacataccataatgggctgtcaataatccattggaattgaccgggtcctgcataaattaaaaagaactgtactaacagtggcgtgcctgtgaataaagtaaggtataaattgaccgcactttttatccatttattttccattgaaagtaaaaaagtaagaaataaggctaaaaagaaagcaatcagtaaggatacgacagtaagcaacaaactcgttggaatcccttttacgatcacgcttaaatattcttgaaacattatttcacgcccctttcaaaacgagtaaaacgcagctctaattttcgaataccaacttggctaattaatgtcactgccaaataaattaacgcagcaataccataccaagtaaaaggctgatgtgtattggtattaatcagatccgcttggtgcatcaaatcgtccacaccaattaatgaaaccaatgccgtatcttttagcaatacaagccattgggtgcttaaaccaggtaaggcgtgacgccatacttgtggcataacaatatgaatgaacgtatagcttttgcttaagcctaacgctgcacctgattcccattgtccttttggtatggcttgaattgcaccgcgtaatgtttgtgaagcataagctgcaaaaataagagaaagcgcaagcacgccacagccaaatgccccaaattcaatgtattctcctgtcagcatttctactaattcagtagaaccaaaatagacaagtaatacaacaataatttcgggtaagccacgtaataatgccacaaatactgtcatcggcttgccaacaaagcgatttgcttcaagcacggcaaaaataaggcttaaaaataagcctaagagcaatgaacagaccgcaagccctaaagtcattagagcagcggtaaacattaaagaaagaaagtcagaaaacataaattattttgttatccatttatcatagattttttggtattcgccatttgctttaattgcagctaaacctttgtttaattgtgcagccaaatctttgtttgatttgtgcattgcaatacctaaaccattaccaaaatattttttattggtcactttttcgcctataaattgaatttctggctctttggaaatcatatcggcgagcacggcggtatcgccaaaaataatgtcaatccgaccgctctttaagtctaaaatggcattttgtaaacttgcataggattttggactatattgcttggtttccgctacggtatattgttggaatgttgtaccattttgaacacctatattttttgcactttctaaggttgctttgcctttaagagcaacatagcttgcagagctatcgtaatacgcatcagagaataacacttgttttgcacgagcatcggtaatatcaattgcggaaattgctgcatcaaaacgttttgcttttaaatttggaattaacgcatcaaaggtttcgctcttgaatttacaggttgcttgaatttcttgacaaattgcatttgtcacatcaacatcaaacccgataatttcgccttttgcatttgtggtttcaaatggtggatagctaggttgcattgcaaaagtgagttcttgtgcacttgctgctacggatgcacctaataaaatggcagttaataatgtttttttcatcgtaagctccttattttctagtgagaaagatagtgtttaaattgttccgtttttggattttcaaagcaatcagccgatcccatttcgacgattttaccttgttccatatagacgacttttgtcgccactttttgcgccacattgacttcgtgggtcacaatcacttgcgtaatgccagtttcttgtaattctttaataatatctacaacttgcgcagtaatttctggatctagcgcagccgttggttcatcaaataatagaacttgtggcttcatcattagtgcgcgcgctattgcaacacgttgttgctgaccgcctgataaatgcaatggaaagcgatcggcaagttgttctaaacgtaaacgttttaacaattccattgcatcggttttcgcttcattttcactcacaccacgcactttcattggtgcttcaattaggttttcaattaccgttaagtgcggccaaagatgatattgttgaaacaccattcctacatcttggcgtaattgttggattgctttgggatttgccattgcattggataaattaaattcattatttgcaatacttaattcaccagactttggcacttctaacaaatttaatgtgcgaattaatgtacttttgcctgcaccacttgggcccagcaacacaacggtatcgccttcttctgcttcaaggttaatatcaaataacgtttgtgatgaaccgtaaaagaaattgagatttttaacacgaatagccatttttcttctctatgctttataagatgraaaaatattacatytttatgcataattatgcaagtgctattaataaaaaatcccaagaaattttgggatttaaaaaacttgattgaaatcaaccgcactttaggcttgttttgccatttcaaactcaattaacatcattaaaatatgaataactttgatatggatttcttgaatacgatctgcataacggaaatggggtacgcgaatttcaacatctgctaatcctgccatttttccgccatctttgcctgtcatcgcaatcactttcatgccttttgtttttgccgcttcaatagcatttaagatattttttgaattgcctgaagtggataaaccgaataacacatcgcctttttgccccaccgcttcaacatagcgagaaaagacatattcataaccaaaatcattacttacacagcttaaatggcttgcatctgaaatcgcaatagcaggataacctgggcgattttcacgataacgacccgttaattcttctgcaaaatgcatcgcatcacagtgcgaaccgccattaccacaagaaagcactttgcctccttgtttgaagctattcgaaattaataatgccgcttcttgaattaatttaatgttattttcgtcagaaataaatttgtttaacacatcttgtgcttccacaagttcagatttgatttgatctaaatacattgattgctccttgttgggaataaaatcgcgatggcattgtatagcagatgaagattcttcgctagcctaaataaaaattcatcttttttcgatgaaatgatgattttttgcgatttagatcgaaaaaataagtttgagtagttggggatttttcaagatatgtttatcttacgtaaattcttagccctttaattttcaaaaacacaatgaaattttaccgcactttgttacttttctttgctagttcttttgcttttgctaactcagatttaatgcttcttcatacctataataatcaacccatagagggttgggtaatgtctgaaaagttagatggtgtacgcggttattggaatggaaagcaattattaacccgacaagggcaacgtttatcgccgccagcttatttcattaaggattttccgccttttgcgattgatggcgaattatttagtgagcgaaatcattttgaggaaatttcatccatcacaaaatcttttaaaggcgatggttgggaaaaactgaaattgtatgtttttgatgtgcctgatgcagagggcaatttatttgagcgtttagctaaattaaaagcgcatttacttgaacatcctacaacttatattgaaattattgagcaaattcctgttaaagataaaacccatttatatcaatttcttgcacaagtcgaaaatttgcaaggcgagggcgttgttgtacgtaaccctaatgcaccttatgaacgtaagcgaagtcacaaattttaaaattgaaaacagcacgaggtgaagaatgtacggttattgcacaccataaaggcaaaggacaatttgaaaatgtgatgggtgctttaacttgtaaaaatcatcggggagaatttaaaatcggttcgggttttaatttaaacgaacgagaaaatccccctccgataggntctgtgattacttataaatatcgaggcattacgaatagtggaaaacctcgatttgcaacctattggcgagagaaaaaatgagcctatttataaatctgacaaaatgaatttaatcaatatggaaacaagcgattaattttccatcagtatgttgctccaagtgcggttgattttcacgacatttttctgtcgctttccaacaacgaggattaaatgcacagccttttggaggattaatcgggcttggtaattcgcctgtcagcttaatacgctcacggcgcaagtttggcgacaaacgtggtgtcgctgaaagtaacgctttggtataaggatgctgaggattagaaaaaatctgctctgtcgtccctttttcaatacaacgacctagatacattaccatcacttcatcagcgatatgttctaccacagaaagatcgtgtgaaatgaacacgtaagacaagcctaattcatcttgtaaatccatcattaaattcagtacttgtgcacgcacggaaacatccaatgcagaaacaggctcatcggcaacgacaacatctggntctaacattaaaccacgagcgatggcaatacgttggcgttgtccgcctgagaacatgtgaggataacgatcataaaattcagcgcgcaagcccactttttccatcatcgataaaactttttctcgacgttctttggcggaaagttttgtattgatgattaatggttcttccaaaattgaaccaatctttttgcgtggatttaacgatgcgtaaggattttgaaaaactatttgaatttttttacgacgtagtgcttttgtttcagaatcattttctaaaaaattatgccctttgtaataaagttcgcctttggttggttcttcaatcattgtcaataaacgacctagcgttgattttccacaaccagattcccccacgactgctaaagttttacctcgttcaagctgaaaagagacaccatccaacgcttttacttgctgtggttttgcaaacaagcctttttttacagggtaatatttttttaagccaatggcatttaataatggcgtattttcttttacttcattcgtcattattaagctccttgatattcaactggattgccttgctcgttcagcggagtatggcattttactttacgcgaaccgatatgatgcaattgaggttcaacttggcgacaatattcggtggcataagggcagcgaggatttaataaacagcctgttgggcgatcgtattttccagggacgaccccttgtaatgattctaagcgagattttccctctgcaaattcaggtaatgaacgtaacaaggcttgtgtgtaaggatgttttggttcgcggaaaatatcttttgcggtgccttcttcaacgatttgtccagcatacatcacgataattcgctctgccgcttcagccacaagtgctagatcgtgagtaatcaaaattagggacatgcattctttcttttgcaattcaagtaagagttccataatttgagcttggatagtcacgtccaatgccgtggttggttcgtcagcaatcaataatttaggtctgcaagcaattgccatcgcaatcatcacgcgctggctcattccaccagacagctgatggggataaacatcaatccgagattcaggatcaggaataccgaccaattttaaaagctctaaagtgcggtcttttctcgccttttttgtgccgccttcgtgagtttttaacgcttccataatttggaagcccacagtataagcaggattcaaacttgtcatcggatcttggaaaatcattgctacatcagcaccaataagctggcgtttagctttactctctaaagtgagtaaatcagtattttcaaattgcaaggattcagcagatacacgtccaggatgatcaattaatcccataattgcgagagaactcacagatttacctgagcctgattctcctacaatgccaagcacttcgccttgtgcgacttgatagctaatgcgatccactgctttaaatggcgtttttttatcgccaaagtgaacagaaagttcttttacgtctaataatgccattctgttttcctattgtttgagttttggatcaagggcatcacgcaagccatcgcccattaagttgaaagctaataccaaagataaaatcactaagccaggaattgtaactaaccagtttgccgcttgcataaaaccacgtgcttctgaaagcattgtgccaagttcaggtgttggtggttttgcaccaatgcctaagaaaccaagtgtcgcgagttctaagatagcattggatattcccatagtcatttgcacaattaaaggggctaaacagtttggtaaaatcacaataaacatgaggcgtaaaatacctgcccctgccactttagatgaagtcacataatcacgatttttttcattcatcatcgctgctcgagttaaacgcacatagctaggaatcgataccacggcgatcgctaaagtggcattggcgagtgatggctctaaaatagagacgactacaatcgtcaaaagtaagtttggaattgcgagcataatatcaattaggcgaatgataattgtatctagcacgccgccataatagccagaaatcaagccaaggctggtaccaaaggcgcaagatagtaatacgatgataaatcccgcaaagacggaaattcgcgttccataaataatacgcgaaagaatatctcgcccaatatcgtctgtgccgagtaaataagcaggattaccgccctcataccaagcgggtggcagtaaaagtgcggtacgatttttttctgttggntcaaaaggtgcaatataaggcgcgagaatgctgattaaggcaacaatcaaataaaaattaaaccaattagcgcaccacgattttktttaaagtaaaaccaaaattcttgtaagggtgtttttggcgcgaaagttaaaggcgtgtcagacataatttctcctacaattaatgacggatacgcggattgaccacgccgtaaagtaaatcgacggttaaatttaccacaataataatcgtcgcaataatcagtacagaaccttgcaacactggataatcacgggcttgaatggcatcaataatccattttccaatccccggccaagagaaaatagtttctgtgagaactgcaccagaaagcaattgagctacaattaacccgaccacagtgacaacaggaattaacgcattacgcaatgcgtgaacaataacaattcgagtatagcttaaaccttttgcttttgccgtgcgaatgtaatcttcgcctaatacttccagcattgcagatcgtgtcatacgcgtaataatggcgagaggaactgtgcctaggactattgcaggaagaattaaggatttcaccgcattttcgaaggcaccagaaacacctgaaagccagctatcaataagcataaatcctgttggtgtatcgatccaaaattcattatctaaacgcccaccttgtggcaaaccgagttgtggcgaaacatataaaattaaaattaaaccccaccagaaaatcggcatagaataacctgtgagcgatgcagctgtaacggtgtgagaaatccaactgtctttttttactgcggcaatcgtgcctaaaattattccacctaataatgaccaaaataacgcaaaaaaagctaattcagcggtagcagggaaaagcgtaaaaaattcagtaaggacaggttgttgagtgcggaacgatgcaccgaaatccccttgaattacattgccaatatagtggaaatattgctgataaagaggtaaatctaaacccaattggtgcatcatttgttgatgtacttctgccgttaagccacgttcccccatcataatttccacaggatcaccgggaataaaatgcacaagggcaaaggtaataagagtaatggcaataaaagtagggatcaccattaagattcgtttgaatacaaatttaaacattccatcactcgtagataataaaagtgcggtaaaaattcaccgcacncttcaaagaaattaatcggtaaaaaatataatactcttgaattctaccgcactttttccaattttgccaaatgcgcaatcaaccatttaatgccttgcgcttggaatgctatttgtaaacgtgtgttattttcagaaccttccacattaatcactgtgccgaaaccaaatttttcgtgtttaactttttgacccattttccattcattttcgaccgcactggtattcgacaatgaaccgacttttgctaggttcatcgcacgagtgactgtccctcgtaaacgaatttnttggatacattctctcggtaattctgcgataaaccgtgatggcaaatggcgttcttctttggcatataatcgacggctttccgcataagagatggtcagttttttcttcgcgcgagtaataccgacataagctaaacgacgctcttcttctaaacgtccgggttcttcaaaagaacgaaaacttgggaataatccttcttctacgcccaccataaatacacgaggaaattctaagcctttcgcagagtgcaacgtcatcatttctacacaagattgatgcggcgaggcttgttcttcgccagcttctaaggaagcgtgcgttaaaaaggcagtgagttcggtcatttcttccgcattatcaggtttgataaattcacgggttgcggtaactaattcttccaagttttcaatacgcacttcgcctttttcgcctttttcttgttgatacatttcatataagcccgaatgtttaatcacaaaatcagtttgtgcgaaaagcggcatttctgcggtatcaagttgtagtgaattaattaattcttggaaacgtaataaggctgttgaggctcgccctgccaacatattttcttgtgttgcgacttgtactgcttgccataaggtaatttggcgttcgcgtgttaagttacgcaatatatctaaagtgcggtcgccaatgccacgggttggcgtattaattacacgctcaaaagccgcatcatcttgacgattattaatcaaacgaagataggctaacgcatctttaatttcttgacgttcgaagaaacgcataccgccataaatacggtatggaatttgacaacgaattaaagcttcttcaataacccgtgattggctattactacgataaagtacagcgcaatcatcaagttttccgccatgttctacccaatcctgaatttgtgaagcgacaaattttgcttcatctaattcattaaaggcagaatagatgcccacaggatcgcctttctcaccctctgtccataaatttttaccaagacgatcactattgtttgcaattaattcatttgcgctgtttaggatattggcggtagaacgatagttttgttcaaggcgaattgtttcggctttgaaatctttcaagaatttttggatattttctatttgtgcaccacgccaaccgtatatagattgatcatcatcgcccacaatcatgacttggcctgtttttccagcaagaattttgatccatttatattggattttattggtgtcttgaaattcatccaccaaaatatgctgaaaacgttgttgataacgttgcaaaattaatggttttttctcaaataattcatagacccgaattaataattcagcaaaatcgaccaaccctgcgcgatcgcaagtgtcttgatagatctgataaattttaatccattcacgttcttggcgatcattaaaatcttcaatatcatttggtcgcaagccttcatcttttttgttattgatgtaccaacaagcctgtttaggcggaaaagctttttcatcaaaattatgtaattttaataatcgtttaattaaacgaagttgatcttctgaatctaaaatttggaaatcttgtggcaatcccacatctaaatgatgagctcgcaacaaacgatgagcaatgctatggaaggtgccaatccacataccaaataattgatgttgtgcgtgtttggcaagggtagattgaatacgatgacgcatttctgctgcggctttattggtaaacgtcaccgccataatgctgccttcagaaatattttcgaccgcaattaaccaagcaatacggtgcgtcaatacacgcgttttgcccgagcctgcaccagctagcactaagtgattaccaagaggagcagctacgcgttcgcgttgtttatcgttgagtccgtcaagtaattcagaaatatccatcataaactatctttaatctgtttaaatttacagttattatagtcccatctatcttgtgaaacaataagatttgtgagtatatcaaaagtagggtagaacattttaagaataatattaagcgggattctcctatatccttaaactcaacatcaaaaccatatgctttgaaagctatttttatactatttataaacaaacttttaattcgtttacctctcattcctaaaatgcaaggtttctcatttttccaaaaatacccatgatgacaataatagcataggaatgttgtttaatgacttaatcaatacttgatttgctaggattcctgtaatgattttataaacatttgcttttctttctacttgcacgccattttacgcatagtcggtgattttgtccgaattaagttttaggttaaaaagttactcaaattcaatgttattcataattaatacaaataagaaagggtgagatatggtacaaaattccaaaaaatggttagcacaaaggaatgggagaagtgtgctatccaagtttcattatgatcattctctaaagtagaaaacgtcatatactaaattatatactgatcaaaaaataatatttccttctattactcaataccaatcaatttatgtgtttgtaaacttagctgccatttaggtttatttgaacgttgattcaattgaccaagtaaagtgatagtctcaagtaaattcattttcccatcaatttcacaaggtgaaagatagtaattctttgcttttattttttgctcgatcaattcacaaaatgatggcatattactgtccattacaatacgtacttcatttgcaaatggaatgcaacgcttttcatacttatgagcataaaggctcttaggactcgtcgcaatataatctatttgtgcaggaattgcttttagaccattggtttcaattgcaagaaaatagccatctgatttaaattgctcaagtaagtattcaatttttggtacaattgttggctcaccacctgtgatgataatattctttgacgaaaatgaccgcactttttctagaatttgtgatacagaccagcgtttaaaattattataaggtgtatcacaccaaggacagtctagattgcatttaccaaatcgtacaaaaacacttggcattcccgtattgaagccctccccttgcagactttcaaaaatttcgactatgttaaagttcggttcaaaatcatgatatttttccatcaacatttactcctgatactcgcaaaatgaagttggggtttcccataaacgaatggatgatatggacagttgttcatcatgttttaaacgattaaaaataaaacgagctatttcttctgccgtagttctaaagggaacaccaaaagtttttgagtttaacttttgcaatagagtggcaatttggctttctcgctcattggtttgatcataaataaaggcgtgatccatcggatctaaaataacttttttcacaatagactttagatctgaaaaatcaatgaccattgctttttttgcacctgatttatataagtcacccgaaatttcaacttgtaatttatatgtgtgtccatgtaaattttgacatttcccatcatgtccatctaataaatgtgccatgtcaaagctaaattctttggaaattttaaacattttttctacctttttgagtcaaatatttctttaaacctttattgcgtaaaatacagcttgggcattttctgcatccaccttcgatgccttcatagcaagtgtgagtatgtttttgtacataatctaatacgcctaaattcatcagcaagttgccaagtttgggctttagtgagatacattaatggtgttttggatattggaattggataatccatagctaaatttaatgtgacattcattgacttgataaacacatctcggcaatctggataaccgctgaaatctgtttcacatacgccagtgataatatcttgaatgccttggcctttcgcataaatcgctgcataaagtaaaaatagggcattgcgaccatcaacaaaagtgtttggcaattcattctctttttgctcaatatgcgcttgttcatccattaatgcattatgcgtgatagctttcataacagatgtatcaatcaaggtttgtttaatgccgagatcttgcgcaatagtgcgcgccttttctaactcaatagcatgacgctgcccatattgaaaggtaatggcttctatgttttctttgccgtattcagcaatagcttggaataaacaagtcgtggagtcttgtccacctgaaaagatgacaatcgctttacgatcgtggtttggattgaaaatattcatattttacctagttttttattgtaggaggtttgcgaactacggggggtattctagtggggaagttctattttagcaagacaagtgaaatatttcgttggatgtgaagtcgttgtgctacaattcgcaggtttttaatttagcaaaaaggtttacttatgaaaaaatggttgttgattatcgcaggcgcgttgattatttcagcttgcgcaaataaggatgtgtattttaacggtgcagaaggttcgcattcaggtgttaaatttgataaagattctcgccaatggggattaaatcaataaaaaagtgcggttgatttttaaccgcactttcgttttttggtagaaattattctactttcacaatccagccttcaggtgcttcgatatcaccgaattgaatgcctgtnaattcatcataaagacgacgggtaacagggcctacttcagtttctgaatcgaatacgtggaattttccgttgtgttgaatgccgcccactggggtaatcaccgccgctgtaccgcacgcaccagcttctacgaattgatcgagttgatcgatatacacatcgccttcaatagcttccatacctaaacgctcttttgcgatatgtaaaagagagtatttagtgatacttggtaaaatagattctgattttggtgtgatgaatttattgtcttttgtgatcccaaagaagtttgccgcaccgacttcttcaattttggtgtgagtttttggatctaaatagattgcatccgcaaatttacgttctggcgtaccttgttctgcggctaattcgtgtggaagtaagcttgctgcgtagttcccacccactttcacaccaccagtgcccattggtgcagcacggtcataatcggtcgtgataaagtttgatggagccaaaccacctttgaagtaagcacccactgggcaacaaaaaacagagaaaataaactctggtgccgttttcacgccgatattttcgcccacgccaattaagaatggacgtaagtataaggttgcaccagaaccgtaaggacccaaccaatcttggttagctttaaccacttctttacatgcacgcacgaataattcagttggtacgcgtggcattaaaagacggtctgcggtacgttgcatacgctctgcatttgcttgcgggcggaataagttgattgaaccatctttgcaacggtaagcctttaatccttcaaaacattgctgaccgtagtgaagagcggttgaaccttcgtgaatatgtaatgtgctatctgtagtgagttttccttcgtcccatttgccatctttccagtgagcgatgaagcggtaatctgttttaatataactaaaaccaaggttattccagtctaagtctttcattttacttccttaatattattttttgaatgaaatttcgcttaatctacaccattcctgaagtgatttaaataataaattctcgaaatgatgcaatttttagccaactaaaaaggaataatgaaattttggaaacagggcaggaaataacgatatagttatgctaaaatcgggatgaaaaaaacgccactcaatgagagcagcgtttaaccaaatcggtttaataatatacaggaagtaaatgagtaacaaattgttactcaagttcggtttcccgaactatatgcaaacacaacatcatacttaagtctgaaactcattaactagtaaggaattaccaatcattaagtatggttgtattgtaaggaaaagggtaggaaaggacaagtgacgttttttnatttgaggtattagaaaaactaatttgaaataaatcttgtccattatagacgaaaattttataaatggaaatncttatgtataancgtttgccaccattgaattcactaaaatcttttgagtcggctgctcgttatttaagttttactaaagcagcagatgagctttgtgttacacaggcggcggttagtcatcaaattaaattattagaagantttttagggattgatttatttaagcgaaagantcgttctttagaattaacggagcttggtaaagcttattttgttgatattaataaaattctgcgtcgcttaaatgaagcaacagagcgattattaacgttaaaaacggatccgcatttaaatattagcgtgccacaaacttttggtatccaatggttagtgccacatttaagtgaatttaatcagctttatccgcaaattgaggttcgtttaacaggcgtggatcaagatgaaggtttgttaaataaagaaattgatcttgccatttattatggtttgggaaattggcagaatcttcaagtagatcgtctttgcgaagaaaatttattgattttagcctcacctgaattgctagcagaaaatccaattattcagcctgaagatttaaaaaaacacacattaattcacattcatacctgtgataattggcaagcgatggcaaatcatttacagttagatgatttaaatattcagcaaggaccgttatttagccatacatttatggcgttacaggcggctattcacgggcaaggcattgtattagctaatcgcttattagccttgcaagaaattgaaaatggatcattgcaagcagtgttgccgactaatttgcctgatccaaaatcattttatgtggtcaatcatcttgatcgccttgatgaccaaaaaattcaagcattccgtcagtggattattaactcaattaaacaagaagaaaatgaataaactcgcattatattgtcgcccaggttttgagaaagaagtcgccgcagagattaccgatcaagcaagtcatttaggtgtatttggttttgctcgagtgcaagataattcgggctacgtgatttttgaatgttatcaacctgatgaggcagatcgccttgcccgagacattccttttaatcgtttgatttttgctcgtcagatgatggttatttccgatttattggaagatttagatcctgctgatcgtattagtcccatcgtggtggcgtttgaagaattatcacaacaagttaattttgctcaatctagcgagctttttgtagaaactgcagatacaaatgaagcgaaggagctttccactttttgtcgtaaatttaccgtgcctttacgtcaggcattgaaaaaacaaggttggctttcggcaaaggcgagtcaaaagtgcggtcaatttttacattgtttttttgtaaaaccgaattgctgttatgtgggatattcttatgtggataatcattcctcccattttatgggaatccctcgtttaaaatttcctgcagatgcgccgagtcgctccacgttaaaactagaagaagctattttgacttttattccgcgtaaagaagagaataaacgtttaaatgaaaatatgattggcgttgatttaggggcttgccctggtggttggacgtatcaattagttaaacgcggtttatttgtttatgctgttgatcacggaaaaatggcggcgagtttgcatgatacggggcgcattgaacattgcgcggaagatggttttaaatttcagcctcccaaaaggaaaaaagtagattggttagtctgtgatatggtggaacaaccaagtcgtatttctttattgattggtaaatggttgttgaatggttggtgccgagaaaccatcttcaatttaaaattacccatgaaaaaacgttatcaagaagtgatattatgtttagaaaacttggctgttatgttggctgagcagaatttaaattttgatatccaagcaaaacatttatatcacgatcgtgaagaaatcacggttcatatagcattaaaaccttgagtgaactgttttcataaccaaaaaggacgtcgcgaatgaatttacacgaataccaagcaaaacaactatttgagcattatggattacccgtaaaaaatggggcagtctgtcaatctgttgaggatgtcgatttggtactggctcaactttcaggcggtaagtgggcagcgaaatgccaagttcatgctggtgggcgtggtaaagcgggtggcgttaaattggtacaggatgtagaggaagcgagagcttttgcagaaaaatggctgggacaacgtttagtcacttttcaaacggataaattgggtcagccagtaaaccagatttattttgaagaaacttgcgatattgataaagaattttacttaagtgcggttgttgatcgcacctctcaaaaagtggtgtttattgcttcctctgagggtggaatgaatattgaagaagtcgtgcaaaattcaccgcacttactccataaagtaaccattgancctttatttggaggattgccttatcaaggccgtgaattggcgtttaaattagggttaagtggtacgcaaaacaaacagtttaccgatatctttatgggcttatctcgtttgtttttagaaaaagatttatctttactggaagtcaatccgcttgttctcactccacaaggcaatttggtttgtctcgatgccaaaatatctgtcgatgataacgctttatttcgccataaagatttattagcactgcaagatttaactcaaaatgatgcccgtgaagcagaagctgaaaaattccagttaaactatgtggctttagagggcgatattggttgtatggtaaacggggctgggcttgcaatgggcaccatggatattgtgaaactctatggtgggaagcctgcgaattttcttgatgtgggtggtggtgcaacgcaagagcgggttgctgaagcgttcaaaatcattttaaccgatccttccgttaaagtgattttagtgaatatttttggtggcattgttcgttgtgatttgattgctgaaggtgtgattgctgcagtaaatgaagtgggcgtgagagtgcctgtggttgtgcgattagaaggaacgaatgctgaaatgggtcgccaaattttagcggaaagcgacgttaatattcttaccgcacagagtttacaacaagccgcagaattagccgtgaatgcagcaaaaggagaacactaatggcgattttaattgataaaaataccaaagtgatttgccaaggttttactggtggacaagggacttttcattctgaacaagcattggcctacggaacgcaattagttggtggcgtatcgccaaataaaggtggaaccactcatcttggtttacctgtatttaatacagttcgtgaagctgtcgaaaatacgggggtaacagcgacagtcatttatgtgccagcatcattttgtaaagatgccataattgaagctattgatgcagggattcagttaattgtctgtattactgagggtattcctacattggatatgcttaaagtgaaacagaaattaaatgaaacgggcgtagtaatgattgggccaaattgcccaggtgtgattacgcctgatgaatgtaaaatcggcattatgcccgctcacatacataaaaaaggtaaagtggggattgtttctcgttctggaactttaacttatgaagcggtaaaacaaactacagatgaaggctttggacaatcgacttgtgtgggtatcgggggagatcctattccaggttctagttttattgatattcttgaaagatttcaacaagatcccgaaacagaagccattgtgatgattggcgagattggcggctctgcagaggaagaagcagcaatcttcattaaagataatgtcactaaaccagtggttgcgtatattgcgggtatcactgcgccaaaaggaaaacggatggggcatgcgggagccattattagcggcggaaaaggtactgcagtagaaaaaattgcagcgttagaagccgctggtgtgacctgtgtaaaaagcctcgctgaaattggtgaagccttgagaaagctattaaaatcatctaaaaattaaccgcactttagttttctaaagcgtagattggctttctacgcctttatttttatatgctcgccattataaagtgagcacaaaattgctataatcagcgcacattttttaaggaagaaacacatgagccaattttnctatatccaccctgaaaatccacaagcgcgcttgattaatcaagccgtagagattttacaaaaaggcggtgtgattgtgtatccaacggattcgggatatgccttgggctgtatgatgggcgataaacacgcaatggatcgcattgtagcaattcgtaaattgcctgaaggacataattttaccttggtgtgtagcgatttgtcggaactttcaacttatgcaagggtaaataataccgcttatcgtttgattaaaaataatacgccagggcgttatacttttattcttacagcaacgaaagaattaccgcgtcgtttaatgacatcaaaacgtaaaaccattggtttacgcgtaccagataataaaattgctttagatttgctttcagccttaggcgagccgattttatcttgttcgttaatgttgccgaatgaagaacatactacgcaatccgatcctgaagaaattcgtgatcgtttggaacatcaagtggatttaattattcatggtggatatttagggcaagagcctacaacagtggtagatttaacggaagaatcgccagtgattttacgcgaaggaagtggaagtactgctccttttatttaacttatagacgcttgtgaaagcgacctttccattattcaaggaaaacaatgaaacctagtcaaaaacaaactcaaagacaaccgcacttttccaaagattcagcaaagaaacgtgatttttcagctaaaaatgacagacgttcagtatctcgtactgctcgcatagaaacagcaaatacgaaaaaaagtgcggttaattctgacaacaaatttttatctaagccaaaagcgaaacctgttgtaagagcctcgaatcaaccgaaagcagagggcgaaaaattacagaaagttttagcgcgtgctggacaaggctctcgtcgtgaaattgaaacgatgattgccgcaggcagagtgagcgtagagggtaaaattgcgactttgggcgatcgtattgacgtacattctggcgtgaaagtgcgtattgatggtcaaatcattaatcttagccacacacaaaaagaaatttgccgtgtattaatgtattacaaacctgaaggcgaactttgtacacgtagcgacccagaagggcgcgcgaccgtgtttgatcgtttgccgcgtttaacaggctctcgttggattgcggtggggcgtttagatattaatacatcgggtttattgctttttaccactgatggcgaattagcaaatcgtttaatgcacccaagccgtgaagttgaacgtgaatattctgtgcgtgtatttggtcaagttgatgatgcgatgttagcacgtttacgtaaaggcgttcagcttgaagatggccttgccaactttaaagaaattaaatttacaggcggtgtgggtattaaccaatggtatgacgtaaccttgatggagggacgtaaccgtgaggttcgtcgtttgtgggaatcccaagggattcaagttagccgcttgattcgtattcgttatggaaatatcaaactgatgaaaggtttgcctcgtggtggctgggaagaaatggatcttgaaaacgtcaattatttacgtgaattggtgggattacctgctgagactgaaacgaaattagatgtaaaacaggctagtcgtcgtccaaaatctgggcaaattcgtaaagcggtaaaacgttattcggagatgnacaaacgttatnaaaaataaggacttttttatgaaaatgcatcaattgcgttatatcgttgagattgtaaaccaaaatttgaatgtcacagaagctgcaaatgcactttacacatcacagccgggtatcagtaaacaagttcgcctattagaagatgaattaggtctggaaatttttgagcgtcatggcaagcatataaaatcaattacaccagcagggaaaaagattatctcaattgcacgcgagttacttgttaaagcgcaaggtatccgtgccgttgccgatgaatatactcggccaaatcacggtgtattacgtattgcgacgacaaatactcaggctcgttatatgctgccaagcgtgattgaacgtttttctaaaaaatatcctgatgtgagcttgcatattcatcaaggttcgccaacacaaattcacgatgctttaatgtcaggtgaagtggatttggcaattaccactgaagcaccttatttatttgatgatttagttcagattccatgctattggtggaatcgtgccgtgattgtttcgccagaacatccgcttgccaaagtgaaagaactgaccattgaggaattaggcaaatacccacttgtgacttacacgtttggttttacgggtgtttctgatttagattacgcatttaatagtgcaggcattttaccaaatatagtttttacggctaccgatgctgatgttattaaaacttatgtgcgcttgggtttaggggtgggcattatggcatctatggcacatacggcattagatacggatcttgtgctaattgatgcaagccatttgttccgcccgagtatgacgaatattgcatttaaacatagcacgttcttacgtaattatatgtacgatttcatggaatatttttcaccgcacttaactcgtagtgtcgtagaaaaagccgagcgtttgcgagataacaattcagtgaaaaaattatttgaaggcattgaattggaaacaaaataacaatgtccaaatgaagtgcggttgaaatttaataagaattttaatcgcacttaaaagattaaaacagatcgtgatatttcactaaatccttacgctgaatagcaaatacgcctagtccgccatttttaagttctacccattcaaatggtacatctggatattgctcaattaagctaatcatactattacccacttcacacaccaacacgccattttcggttaagtaatctggtgcttgttttaaaatttgtttggtaatgtttaagccatcactgccagaacctaaggctaactctggttcaaaatggaattcttctggcatatcggcgagatcttcttcatccacataaggtggattggtcacgataagatcgtatttttgtcccaaaatattttcaaataagtttgattgaatcgggaatacacgatgctctaattgatggcgtgaaatattgatctccgcgacattaagtgcatcaaccgataaatctaccgcatctacttccgcattcgggaaagcataagcacaagcaatggcaatacaaccgctgcctgtgcatagatcgagaatatgatttggttcttgtgaaattaaatcttcaaatcgatcttgaattaaagcactaattggagaacgtggaataatggttcgttcatcgacataaaattcgtgaccgcagaaccaagcactatttgttaaatatgccacaggtacgcgttgttcgattcgggttaatacaagttgaactaaggtttctttttcagatggggttaatcgactgttaaataattcggtaggtaaatcaatgggtaaatgtaagctacttaaaacgagttgcaggctttcatcccaaggattatcgtgcccttgcccgaagtaaatatcagatcgattgagaatgctatacgtccaacgcagaaaatcttggatggtttgcagttcgtttgcaacattatcttccaagatagttgcaactaattcttggttatgtgaagtttccatcgcatttctccataaaagtgagtagaaaagttagcataaaattaggtatgaaaatttggcgtagttataccacagatgagaatgtagaactatgatatgatacgcaaaatttgaaaattaatgagaaaaaaatgcaagacgaatttgatttattccgcacggaaaccaaaggcattaagccaattaaacaagatacttttgtggccccccgccaaaaacgtgatcagaaaaaaatagaattgaaagaattacgagcgaaagaagatacattgttctatttttctgatgaatatgagccattactgaatgacaatgatggtgttgtgaaatatttacgtgatggggaagattcccatttattaaaacaacttcgtcgtggagatttttcgccagaattgtttttagatttacacggtttaacccgtgaacaagctaagcaagaattagctgcacttttactggcttgtgaaaatgagcatgttgattgtgccagcattatgacgggctatggcacctttacattgaaaaaacaaattccacgttggctagtacaacatcctaaagtgcgggcattacatcaagcaccaagggagtggggcggtgaagctgcaattttgattttagtcgatttgtaaaaaacgttataaaaaataccgcacttttactgctagggcaaagtgcggtattttcttttatgtttttacttgaattattgtgttgcttgaattgcggttaaggcaattgtgtacacaatatcatcaactaaggcaccacgagataagtcattgactggtttgcgcataccttgaagcattgggccaatagacactaaatctgcagaacgttgtactgctttgtaagtcgtgttacccgtatttaagtcagggaatacaaataccgttgccttacctgctactggtgaatttggtgctttagagcgagccacatcttccatcactgccgcatcgtattgtaatgggccatcgattaataaatcagggcgtttttctttcgcaatacgagttgcttctttcactttttctacatcagcaccgctaccagatgtacctgttgagtaagaaatcatcgcgacttttggatcaataccaaatgctttagcagaatccgcagattgaattgcaatttcagcaagttgttctgcagttggatctgggtttaccgcacagtcaccataaacaagcacttgatctggtaataacataaagaagatcgaagaaacaatagaactacctggtgcagttttgatgatttgcattggtgggcgaatggtgtttgcagtggtgtggacagcgccagatactaaaccatctacttcatttgcttctaacatcatggtaccaagtactacggtgtcttctaattgttcacgagccgcagtttcggtcataccttttgctttacgtaattcaactaaacgatcaacatagttttcacgaacgtcagcaggattgatgattgtaatgcctttacctaatttaacaccttgtgcttctgcaactcgttgaacggatgcaggatctgctaaaagcacacattccgcaatgccacgttctgcacaaagtacggctgctttgattgtacgaggttcatcgccttcaggaagcacaatacgttttttcgccgcacgagcaagttcagttaattggaaacggaatgcaggtggggataagcgaggtaaacggctggaatctgcaactaaattattgataaagtcagcattaaagtgctggctaatgtattgtttaatattttcaatacgttctttgtcatcaacaggcacttcaagattaaaactttgtaaacttaatgcagtttgccaagtattgccttcaatacggaagatcggtaatttcgctttttcaaaagttggacggcaaagtttattaatttgagcatcaattttgtagccgcctgttaataaaataccgccgatttcaataccatttgatgctgcaagagcggctgctacaagcacatctggacgatctgctgaagcgactaataagctgcctgcacggaaatgttctaccatatttggtaaacttcttgcacagaaagtgataccacgaatacggcgattgatttctccttcattaatgattgatgcacctaaatgtttgactaagtcgattgctcgtgtcgcgattaaatttgcattccaaggcacacaagctaataacttgatggcactacctgcaaataacttgtttacttctgtttcgctaatatgattgtgttggaatgaatcaaaaatttcagcaagatctggacgagtacgacctgattcatcaacaggtgcattgaatttgtttacaacaacacctaaaagatttggattgtttttaccaccaaatagagaggctgcagcttctacgcgatcttttaattcggttggcgtttcagttgcaggtgctgcaactaatacaatttccgcatctaatgcttgtgcaatttcatagttgatactgtttgcgtaaccgtgttttcttgtaggtattaagccttcaactacaacgatgtcattatttttggttaattgttggtggttagctacaattttttctaacaatacgtcagactgattttgaccaattaatgattctgccacgcttaacataaaaggttcggcagtttcaaggctagtgctagtgcgaataatagaagttgtgcgatccaatttatcttcgccagtgcttggttgagaaactggtttcataaaagcaacttttgtgcctttttgttcgagagagtggattaatccaagactaatgctagttaaacccacgcctgtacttacagggataagaataatcgtgcgagacatagttaaaccttaatatgtatattttataaataaaaactgccgaaaaattcggcagcttgttgttaaattagaaacaaagttttgcggtatcttgtgcgataaccaattcttcgttagttggaagaacaattgctttaaatgcggaatcatcagtggtgattacaccatctttaccaaaacgtgtggcaagatttcgttcgttatcgattttaatgccgaataattttaagtgatttaaggctaattcacgaacgtgcgctgagttttcgccaataccaccagtgaatgcaattgcatctaagtgatcatcgcccaacacagccatataagcaccaatgtatttcgctaaacgatagctataaacatttaaagcacgtcttgtttctggtttagattcatcatcgtagttatcttcagcataacggcagtcgcttgttacttcagttaaacctaaaagacccgattttttcactaaagtctcttcgatttgatccatagacatacctagtgttttgtataggtagaatacgattgcagggtcaatatcgccacaacgcgtacccattactaaaccttctagcggagttaagcccattgaagtatcaatacattgaccgttacgcacaacagaaacagaaccaccattacctaagtgacaaataatagcatttacttgatctgcaggtttgcctacatatttagcgacttcacgagaaacgaagtagtgacttgtgccgtgtgcaccatagcgacgtacgccgtgttctttatataaagagtatggaagggcataaaggaaggcttcttcaggcatagtttggtggaatgctgtatcaaaaactaccacgtttttatcttttaagtgtgggaatgccttgaatgcttcgcgaataccaattaagtgagcagggttgtgaagtggcgcaaattgtgcagcatcttcaattcctttaacaacttcatctgttacgatgacagattgagtgtatttttcgccaccgtgaacgatacgatgaccaattgccgcgatagaatttttaagctcatcattcagaatgttagatgcgataaaattaagtgcttcagtatgcgctgcgcctgcgcctaaatctgcgttacctttctctccattgagtttccatttgatacgtgcttctggtaagaaaaatgcttcggctaagccagataatttttcttcccctgttgctggatcaagaattgcaaatttgagtgaagaactaccacagttaaggataagaacaagttttgacataggaaccctatatttgattgaggttaatagaaatccatcatctaagatggtttgaaaaatcagacatagaatacaccttttgatgaataaaataaattcatcggtaaggaaaaaatacaaactttatcgtattttttgaaaaattaaactatttttactaaaaatagacttaaaatagcgtatgataagtgcggtcaatttttgaggtgtttttatggcatttttttccatttttaaacaggggcaaatttatcttaatacttggccgctggaggcgaagttaggcattattttccctgaaaaccgtattatgaaagccacgagttttgcacaaaaatttatgccttttgttgctgtgtttgcaattctatggcagcagttttatgcaaaaaatgatttgatggcattttctatcgcaattttgaccgcactttttgccttgcttattccttttcaaggtctttattggcttggtaagcgtgccaatacgccgttagaaaatcaaagtgcggtatggttttatgatatttgcgaacgtttaaaacaactacatgaacccttgccttttgtgcaagaaaaaccgacataccaacatttagcggaagtcttaaagaaagctcaaagtaaattggaacgtgctttttggcaggaaatttagtttacgcaaacgttttctttttggctttatttttgtagaatagctcggtcgttttaaacggccgtttttcattgagagattttttaatgatcgattacattattattggcattatcgctttttccattcttgttagtttattacgcggttttgttcgcgaagtgctttcactcggtagctggattgtggcatttattgtagcaagtcagttctatccttatcttgctgcttatcttacgcaaattgaatcaatgtatattcgtaatggaactgcaatcgccattttgtttgttctgactttaattgtgggtgccatagtaaattatgtgattagtcaattagtggataagacgggtttaagcggcactgatcgcgtattaggtgcagctttcggtttagtgcgcggtgcgctgattgtggctgcgttgttattttttatggatacttttaccaattttgaacaaactgattggtggaaagaatctcaattaattccgcactttggttttattattgaatggttctttcaacaacttcaggcgagttcaagttttttaactccaacgcttaatcaataaggaacacaaaatgtgtggtattgtcggtattgttagccaaagtccggttaatgaatctatttatgcagcattaacccttttgcaacatcgtggacaagatgcggcaggtattgtaacggttgatgatgaaaaccgttttcgcttacgtaaagctaatggtttagtcagtgatgtgtttcatcaagaacatatgctacgattgcaaggaaatgctggattggggcatgttcgctatcctacagcggggagttctagcgtctcagaggcacagcctttttatgtgaattctccctatggtgtcactttagtgcataacggcaacttaaccaactcagtggagttaaaagaaaaggtctttaaaactgctcgccgccatgtaaacactaattcagattccgaacttcttcttaatattctcgccaatcacctcgatcacattcctcaagatcacctcgatccacaagatattttctatgctgttcgtaaaactcacaaggatgttcgcggtgcttatgcttgtttagcgatgattattgggcatggcatggttgcgtttcgtgatccttttggcattcgtcctttggtgttgggtaaacgcgaggaaaatggcaaaaccgattatatgtttgcgtctgaaacagtggctttagatattgtaggtttcgaatttgtgcgtgatattgctgcaggcgaagctgtttatgtgacgtttgatggcgagctttattcacaacaatgtgctgaaagtgcggtgttaaatccttgtatttttgagtatgtttattttgcacgcccagattcaacgattgatggcgtctctgtttatgctgcgcgtgttcacatgggcgaaaaacttggacaaaaaattgcaaaagaatgggctgatgaaattgataatattgatgtggtgattcccgttcctgaaacttcaacagatattgcgttacaaatagctcgtgtactagggaagccttatcgccaaggatttgtgaaaaatcgctatgttggccgtacctttattatgccaggacaagcacagcgtattagttcggttcgtcgtaaattgaataccattaaagctgaatttaaagataaaaacgtgttattggtagacgattctattgttcgtggcacaacctctgagcaaattgttgaaatggctcgctcagctggtgcgaagaaaatttacttcgcctcggctgctccagaaattcgttatccgaatgtatatggtattgatatgccgagtcgcgatgaactgatcgcttatggacgaaatgttgatgaaattgcagaattaattggcgtagataaattaattttccaagatctgaccgcacttactgaatctgttcaattggaaaacccagccattcaaggttttgattgttctgttttcacaggcgaatatattacaggcgatattagccctgaatatttagagaaaatcgcaactcaacgcaatgataacgcaaagaagaaacgagaaaaacaagcatccaatcttgaaatttacaatgaacaataaatgctaggcatttagagggataaaaatcatcgtattaaaagtgcggtgatttttttatttgttttttaggatgtcttctagatagttttcgcaatcagcatattgaaattggaatccagcgttaagtaatttttcaggtacaacattttgactttcgagtaatagatttgctcgctcgccaagaataaaatgtaatagccattttggaatggttgcaaaggcaggacgttttaatagttgagctaaagtgcggttaaatttatgctgttttatagacttgggggcagcgaagttaaacgctcctctgcattctgaatgatcgagtaaaaataaaatgccgtttaccatatcttccaaagcaatccaagggaaatattgctctcccttgcccagtttaccgccaagtccccatttgtagaaaggcaatattttagcaagtgcgccaccttttgtagaaaagaccatgcctgttctaatcaaacaaaccctcccattagcttgttgcgcaatattttcccaatcttggcataattgtgcagtgaaggtttttgctgttttgcttgtttcggtaattttttgttcgtcttgatcgccgtaaattcctgttgctgaacctgatataaaaattgggtgttgctgatattgattaatgaattcaaccagttgagtggtgaggcttaaacgactttctcgtaaaatagatttctggtttttcgaccaaactttatgaaaaattggctcgccagcaagattgatgatggcatcaaactgttcttgtgaattaagttgggaaagtgcggtaataaatttgatgtttttgtgctttgagagagtgtgcggcgaacttgagcgcgttaagatcgtcacttgttcattgcgtaaacagagtcgttcgacaagtgctttgccgataagtcctgttcctcccgttaatagaatattcattacaatgtgttttcaaataaacgttggatattttgcaataattcgtcgataggtttattgtttgtgggcgtgacaaaaatagtatcatcgcctgcgatagtacctaaaatgccttctgattttccaatggaatcaagtaatcgtgcgattaattgagcagcaccgggcgtcgtttttattacgattaacatcgcattgtgatcaacatctaagacaagattttttaatgggctactggtattgggaacacttaattcatttggtaagcaatagaccatttccattttggtattacgggtgcgaactgcgccaaatttgctgagcattcttgatatttttgattgattaataccagtaaagccttgtttttttaaggcatcgacaatttcactttgagaaccaaagcgttcttggttgagtaattctttaaaagcgcgagttaaattctcagtcatctttatttttcaatagtcaaaatttgcataagaattgcataaaaattcactttcatcaactgaaatatgaataagaacaaagagaagaaaatatttatctcagaaatgtgaactagatcatagaatgatatttctctatttgtaattgtaagatgaacattttaaaatcagtctgttttaaattaactaacacataaggagtatttatgaaagttgctgtattaggtgccgcaggtggtattggtcaagcattagcgttattactaaaacttcagttgccagcaggtaccgacttatcattgtatgatattgcccctgttaccccaggtgttgcagtggatgtgagccatattccaacggcagtgaatgtgaaaggtttttctggtgaagatccaactccagcacttgaaggtgcggatgttgtattaatttctgctggtgttgcacgtaaacctggtatggatcgttcagatttattcaatattaatgcaggtatcgtgcgtggtttaattgaaaaagtcgcggttacttgtccgaaagcatgcgttggtatcatcactaacccagtaaatactaccgttgcgattgcggctgaagtgctgaaaaaagcaggcgtttacgacaaacgtaaattatttggtgtgacaactttagacgtgttgcgttctgaaacctttgtggctgaattaaaaggtttaaatgtttctcgtacaagcgttcctgttattggtggtcactctggtgtgactattcttccattactttctcaagttcaatatgcaaaatggaatgaagatgaaatcgaaccattaacaaaacgtatccaaaatgcaggtacagaagtgctcaatgcaaaagcgggtggcggttctgcaaccctttcaatggcgcaagctgcagcacgttttgcgcgttctttagtgaaaggattaagtggcgagacagtggttgaatgtacttatgttgaaggtgatggaaaatatgctcgtttcttctctcagccagttcgtttaggtaaagaaggtgtagaagaaattttaccaattggtccattaagcaattttgaacaacaagccttagaaaatatgttgccaactttacgtgcagatattgaattaggcgaaaaatttattaatggttaatcattaaaaaataagggggagttagctctctttttatgtttcgataaaaaagccaccaaatggtggcttttgtttatatctttattatttctgacgcattgcagggaataagataacatcacgaattgacggtgcatttgcataaagcatcgctagacggtcgatacctaaaccttccccagctgttggtggtaagccgtgttctagtgcaacaacaaagtcttcatctttaaacatcgcttcatcatcgcccgcttctttcgcagccacttgtgcatcaaagcgttcattttgatcttccgcgtcatttaattctgagaaaccgttaccaatttcacgtccgccgatgaataattcaaaacggtcagtcacttcagggttttcatcattacgacgtgcaagtggcgaaatttccgcaggtgagccattaagaaaggttggttgaattaagtgatgttcagccacttcttcaaagattgcattgacaatgctgcctaaaccccaagatttttgtacttcaatacctaagcgttcagcagttgcttttgcacgatcgaagtcataaagatcttcttttacgatacctttatctgcaccatatttaatggttgcatcatgtaatgtaatacgctcaaatggtttgccgaagtcaaattctaaatcaccgtatttcacaatggttgtaccaagaatatcaatcgctaatttacgaagaagttcttcggtgttatccattaaatcatggtagtccgcatatgcttgatagtattcaagcatagtaaattctggattatgacgaacagaaaccccttcattacggaagttacggtttaattcaaatactcgttcaaacccaccaacgactaagcgttttaaataaagttcaggtgcgatacgtaaatacatatccacatctaatgcattgtgatgagtcacgaaaggacgcgcagatgcaccgcctggaatcacttgtaacattggcgtttccacttccataaagcctttagaaatgaaatattcacgaatacccgcgacaactttagaacgaataataaaagtgcggcgagattcttcgttagaaattaaatctaaataacgttggcgataacgaacttcttggtcggttaaaccatggaatttgtctggtaatgggcgaagtgctttggttaaaagttgaacttccgtagttttaacggtgagttcatcagtttttgttttaaataaagtgcctttaatgccaacgatatcacctaaatcccaagtaccaacgtcatctttataaacaccttcaggcaaattatcgcgtgcaacataaagttggattttaccgctcatatcttgaatagtgataaaagttgctttacccattgcacggcgagtcataatacgaccagcaacttgtacttcaatgcctttttcttttaagatttccccgtcttctgcatcatattgattgtgcaaatcttgtgcgagagcatcacgacgaaacttatttggaaaggcattaccttttgcacgtaatgcggctaatttttcacgacggacgagcatttcgccattgagatctaattctttaacttcttgntctgacatattgtttaccttttttataaattaataagaaatttttattttctttgtttactttaggagctgtcgaagactaaaggaaatatattatcgaaagcccccttccgtacgttcgcgccactttccccgtaaacaggggaaggcaagaaatttctacaagcccgcttttaaactcgcttcaataaatcgatctaaatccccgtctaatacggcttgcgtattacggttttctacgccagtacgtaaatctttaatgcgtgaatcgtctaatacataagagcgaatttggcttccccaaccaatgtcagatttattatcttccattgcttgtttatccgcatttttcttttgtaattcaagctcatacaatttcgcttttaattgtttcattgcttgatctttgttcttgtgctgtgaacggtcgttttgacattgcaccacaatgccacttggcatatgggtaattcgcaccgcactttcagttttgtttacgtgctgaccacctgcccctgatgcacgataaacatcaatacgtaaatcagcaggattgatttcaatatcaatatcatcatcaatttcagggtagacaaatgctgcgctgaatgatgtgtgacgacggttattggaatcaaatggacttttacgcactaaacgatgaatccccgtttctgttcgtaaccaaccaaaagcatattcaccgctcactttaatggttgctgatttcaatccagctacatcgccgtcagagacttccatcagttctgttttaaaacctttgctttcagcccaacggagatacatacggagcaacatttctgtccaatcttgagcttcggtgccgccagaacctgcttgtaggtccacatagcaatcgcaagcatcatgttcgccactaaacattcgacggaactctaatttttcgagttgttgttcgagttcatctaattccgctaccgcttcattgaaggtgtcttcatcttctgcttcaatggcaagttctaataatccatcaacgtcttctaaaccttgttctaaatttttgatggtatttacaacttgttctaaagaaacgcgttctttaccaagcgcttgggctttatctggatcattccaaacatctggctgttctaattccccattgacttcttctaaacgctcaactttggcatcgaagtcaaagatacccccgaagcactgaagtgcggtcagataaatcgatgattttattttttacaggattgatttcaaacataataaattcactgtgtgataaagtgtggaattatatgctattttctgatttttggatagtttgaccttgcagaaattagcaatctctctataattttaaactttctcactcaagctaatttaggaacaaaaaatgaagaaaatttttaccgcacttttgtgcgtggctgcggctaatgcaatggcagatgatgcggcaattaaacgcaaattacagtcttttaatatatcaaatattgttattaaatcttcgccgatttcaggcattaaaacggctgttacggatcaaggtatactctatgtgagcgaagatggaaaatatctttttgaaggtaaactttatgaactcacaaataatggccctgttgatgtcgcaggtaaaattttagtggataaacttaattcttataaagacgagatgattgtttatcctgcgaaaaatgaaaaacacgtagtaacagtatttatggatattacctgtcattattgccatttgttacatcagcaattaaaagaatataatgatcttggcattaccgtacgttatttagctttccctcgtgcaggtatgaataatcaaacggcgaaacaaatggaagcgatttggacggcgaaagatcccgtttttgctttaaatgaagcagaaaaaggcaatttaccaaaagaagttaaaacgccaaatatcgtgaaaaaacattatgaattaggtattcaatttggtgtacgaggaacaccaagtattgttacctcaactggtgagcttattggcggttatttaaaacccgctgatttattaagagcacttgaagaaacggcacaataattttataatgaaaaacaaggggcagttgcctaccccttgtgttttaatagtcggtaatgcttaatatgctggggagcttaaaagcattaacaacccanaaattatgatataaatacataatttaggcatcattaaaatccttagctgacacaatagttagactaatggtcagtaggtttaatccctgtcagcattcagggttaaaagccctgaccaacaggaaaaagtatagataaaagagctgttgatttcaacagctttttgcttttaggtatgaattaatatccagtgaaaaaacttatcaaacgccgtgaaattccaattggaaattctgtttcaaaccatcccttattagatcgactttatcgcgctcgtcatattcaaaacaccaaagaattagaccgcactttgaaatcaatgctcaatccaaatcagttatatggcattgagcaagcggtaaatttattagtggaagcctatcaaccacagcaaaaaattgtgattgttggggattttgatgctgacggtgcaaccagcacagcattgagtgtgctggctttaagacaacttggcttttctgatgtggattaccttgtgccaaatcgatttgaacaaggttatggtttgagtattcccgtggctgaaatggcaattgaaaagggcgttcagcttttaatgacggtggataacggcgtttcatcttttgacggtgtggcatttttgaaagaaaaaggcattcgagttttagttacggatcatcatttaccgcccgaaactttgccgccagccgatgcgattgttaatcctaatttaagtcagtgtggttttccttcaaaatccttagcgggcgttggtgtggcgttttatttgatgttagccgtacgagcaaaatttcgtgaactcggtatttttacggcagaaacacaacctaattttactgatttgctcgatctggtggcactaggcactatagctgatgttgttcctttggatcaaaataatcgtatccttgcttatcaaggtttaatgcgtatccgtgctagacactgccgtcttggtattattgcgttggcagaagtggctaaccgtaatgtagagcagtttacttcaagtgatctcggtttttgtattggaccgcgtttaaatgcggcagggcgtttagataatatgtcgattggggtagaacttttgctggcgaacgaaatgtcaaaagccagagaattagctttagatctcgatcagcttaaccaaactcgtaaagaaattgaagcaggtatgaagcttgaggcaataaaaatttgtcaaaatcttaccgcactttttaaagagttaccctatggtattacgctttatcaaccagattggcatcagggcgtattaggcattgtgtcatcaaggattaaggatcaatatcatcgtccagtgattgcctttgcacaagatagtgagggaattttgaaaggttccgcgcgttctattgaaggtttacatatgcgtgatgttctggagcgtattcattcgcaacatcctaatatgattttaaaatttggcggacacgcaatggcggcaggcttgagtattcgcgaagaacattttgcggatttccaacatatttttaatcaaaccgttgccgattggcttgatgaagaacatctacaaggcgtaatttggacagatggcgaactgaattcaaatgaatttaatcttgaaacggcagagctgataaaatcggtaggcacttgggggcaagggtttcctgagccttgctttgatggcgaatttaaaattttagaccagcgcgcaattgggcaaaataaaaatcatctaaaaatgttgctagagccgaaacaaggcggggttttattagatgcgattgcatttaatattaatacaagattgtatcctgatctttcaattaaacaggctcgtttagcctataaattagagattaacgaatttcgtggcaatcgtagcctacaattattggtagattatattgagccgatagatgagtgatagaatgaaattaaaagggttattggcattttgtttgctttttttatcgtcgtttgttttagcagaagtcaatcagaaagaattttcagtgcaaaattctccgcacttgccatcacgggacacaatttattttgaagacgggcgtgattatttttcttataaagaacctattgaacaagcgtctcgaaccgataaaaaaatccgcattcaattcttttttgattacgattgtcgagtatgttcttcagcgcaggatattttagagctttatagccaaatacgcacatataaagttgcgttggaacaatatcctattgcaactgccgataaccagtttagcgcacgcattttttatactttgcaagcattaagtgcgggggaattatctaatgttttattatttgaaacttcagaaaaatcccgttatacagaattgtctacatcaaataaaattcagcaatgggcggaagaacaagggttagataaacagttatttattcaaactgaaaattcacaaagcgtaaaagaacaaattcaaaatgcgattgaattgacggaagaatatggtgtgtttacctatccttacgttgttattgggggaaaatatgtactcactgcgagtacgctttataacgatgattatagcgtagcggtgttagattttttggtaaataaaatagaacaggaacaaaaacaatgaaaatcggaattgttggtgcaatggcacaagaagtcgaaattttaaaaaatttaatggctgatagaacggaaactcgagtagcaagtgcggtcatttttgaaggtaaaattaacggtaaagatgttgcattattgcaatcaggcattggaaaagtggcagctgccmttggcacgacggcgttattgcaattagccaaaccagattgtgtgatcaatactggttctgcaggaggggtagcaaaaggcttaaaagtgggggatattgtgatttctgatgaaacacgctatcacgatgcggatgtgaccgcttttggctatgaaaaagggcagttgcctgctaatctgcggcatttttatcggacaaaaaattagcagatctcgctcaagaaattgcagaaaagcaaggacaatcagtaaaacgtggtttaatttgctctggcgatagttttattaatagtgaagacaaaattgcacaaataaaagcagacttcccgaatgtgacgggggttgaaatggaagccacagcgattgcacaagtttgctatgcgtttaatgtgccttttgtggtggttcgagcaatttctgatgggggcgatggcaaagcaagtatgtcttttgaagagtttttaccattagcggcgaagcagtcttcggcattagtgttagggatgattgatagactgtagtaataatcttttaataagataataaatgctaaaattaaaggcatagctattagctatgcctttttatatgaacctattagaatttatagtttaaactcagaatataagttcttccacgtgcaaagttataaagcacggttttatctgaaccaccgcaagcagaagaatcttgcgcacattctatagaattatttaaacttgaataataacgttgcgaagccgcgtcatttccagcatctaacggatcaacataacgtttatctaatagattttgtacttccgctttaataatcaaatctttgattggttcatagctgacgtgtaaatctaaaataatcggttgttttttaatatcttccgtttttttcacggcatagtaattttcacgacgcaaggtattttttttaaagcgagatccattgatatattcttcttcaattgtcgcacgtttactttttccataataacgagctgccagacctaaggttaatttttgatcaaaccaacgtgtgccaagctctaatctgccgtagtcttttggtagcattgaaacacgagataagccataaccttgtttcaaaatgtcttcttgtgaagcattattcggacgcgggctggcatcggcataattggttggttgatttgttcgttgatatgcataagagacattcgcaaaaaaacgtcccatgtcatagttaatttctaactcgacgccgctctttttcacaataggcttataattttgatgagcaatagtatatttaaatccattactttctgcccacgtaggcatgccatctcgccaccaaacaccataaacattatggatatagtttttaataaagctacgatagcctactaattttacgcctagcacatcgtcttgagtgaagagaccttttttataagtattaaagcctagttgataggtgtcagattgttcaggttttaatgctgtgtttacccctgcattagacacttgagagaaaaacatctcttgaatattcggcattctgtgagtgcgtgaataagtaaaaaatggcataaaataatcactcagttctgcacttaatgtggcagaatgattgaatgcctttttatgccctgatttatgcaaaataggttcattaatttgttgacccgctgtattttcgtaacctacatactcaccattaaaggcataatgggtaaaattcacgctgtaatttaaatgataaatgcctttagaaagtgcggtatcaaaatacacggttttaaatttttgcttgccagaaggttgtaagattactgaacgttgtggtaataaactttttgtgccagaatatcgccctcttttactgtgtgaatataagccttgatcatgtgaagcatcgttataaaacaaacttaattcttctggaaaacggtttttactgtattcattggtaaaatagttaaaacctaatgtggtttttaaatcaatttcttttggcagtaagaaagtatggctgttgtttatatcaacaatatttgcgacatttttagtgataagtttatctgccacttgccagccagcaaaaaaaccgcctttaggataaatagtttttccaatgttatgtgcagccattaaattaagatcaagatagctgttattattgaagttataattgacttggtaattacggttttcaattttgcgagaaccaattttattatccaacgtgcgtaattgcgcccctaaattttggtgatcatcgccatattcaaattttaataaatggctacgagaacgagattgcaaactacccggctcaatcggtgcaacactatattgntctttattacgttcaaatgatttgtcagtttcttcaattccatcattacctttttggagcttttcaatatccttaggtttttttccatttgttaataattcttgtagaatttctcttctagtctttgcagcagatccaatacgataataactacaatcaccatttttctgataatctggtttgttacaagaccaatgttttttgcttaaatcaggtgtccattgcccttcaggatttaaaatataacccgcattacgaaaataagcttctttttctttcgcgagaatatcctgccctaatgatgctaatcgttctccgccaccgatacggtaatcttgagatacttcacgttggctataaccatacaccacgcctacatagccaccattatcaagccattttctgccagcagccattgtcataaaattggatttagtggcattactccctgtcattcctttcagaataatgccaaatggtttgtcatcggtaataacatcattaacgcctaatgttctaaaattagcactgcctgctaacgcatttataccgcttgctcctgaaaagttgcttttattaacatctacacctgcaataaaattaggatcgattgccgcaccaaattgagaacttccgcctgattgacctgagtctaaggctgtagaatagaaggtctgtgttacaccatcaaccatagtattgacacgacctaatccattttcgccacgaatattcacagaaacgacacccgagcctttatcttgttgagtaaatgcaccagggatacttcgaatcacttggtcaatggtttgtgtttccttaaagacattttcacgtgtacttttggctttggcttcagtgaaaggttttttatcgtttgatataactttttccactacatcaatttgtcctaatgtttcttcggcttgagcttgtgtaatcgtcataccgatcgtattaattaggccaagtgtaattaaatttaattttatagctttcttcattatagttcctatttatttttgagaaatattatgattatccattttattaagagggatctcaaggaatgatttaataaatttaatgaaaatacctaaaaaataataaaaaaattaatttttagagagaaaatacgtttagaagatagagaaaaagaaagtttggtttttgcaaaatggacaaattcattcgcaaaatcaaccgcactttaaaataggaaatgaccgcaaaagtgcggtcatttttggcgtaaattttatagattataaaataaaggtactaagaacagcgcgccaagtgcggcaatgataccgtaaatgatcataggtataatggttttcttaataattgtgccttcttggtttgaaatatttaacactgaacttaccgctacaatgttatttatacataccatattccccattgccccaccaacagattgtaaagcaagaacaagtgcgacagaaatgcctgttgtttctgcggtagaaagttgaacactaccaaatgttaggttggatacggtatttgaacctgagaaaaaggaaccaatcgcgcctaagaaagaggagaaaatagtccagttactaccagaaatttcagcaaaagttctacctataatttttaccatagaatgttcgccacccactaacattaggtttaccatcactaaggcaccaattaaggcaataaatggatttttagattgttgtaaacttgataccaaaatctgtttaacatttgaactggaaattttaaagaaaggaatcgcaattagtactgtaatgacaaatggaatcaatgcgggtacgtaaagaagtttatagcttgatgaaacatttgagccaaaaatattttttaagctaaagattaaacctttgctaatttcaaataatcctaacgaacctaatgtggttgagaaccaaatagttgcgtcattcatcattgctttgaatggtaattgatgaatacgagtcacaattaaaaatgcaataagtaaacctgtcggaaataatgctttaactacttctcctgcacttaccgcattattatcaagggtatttgttacttttgctaaaccaatattgcgattagcagcccatacagaaataaataagccgattgcccccccaacgagtgatggaaattcgtaattgacttgagcaatcaagaaataaggtactacgcaacccagtacgctaatatagataaatacgatgtttttacgaatatcatcccaatttactaagatacgaagtgctaataatgggataataagtgcagcaatggagtgtataaatgctgtaatagacccaatttctaaaatcatatcttctgataattttaaagcaccaaaaccaaaccaagttggtgtacctaccgcaccaaaggatacgggaactgagttcataataagtgccaacatcgccacttttaatggatgaaaacctaatcccactaaaataggtgcagcaattgccgctggtgtaccaaaaccacttgctccctcgatcataaaagcaaacgcccaaccaataatcattaattgtgcaacgggatttggattaatatttcctagccattttcgcataatatttgttgcgcctgaaatttcagagaaacggttaaagagaatcgcaccaaaaattactgtaataggtgtttgtaccgcaataattgcagaaacaacatttgcactaatagtgacaatatctgtattaaagtgtaaaagatgnacacccataactaatgtcgcaacccaaggtaaggcaacataagaaggtagcgcgtttctttttaccataagataaatcagtaaaacgataggaaaaatacttagaataaaagacagcataaaatatcctcagagttagattaaaagatgtgattattttntggatttatatgcaaagcatatacctattttaagaaaatgtgatcaanatctcataaaatttaacattttgnttccatttcttacatttttattactatttgtgtttagttatagcattaatagaagaatatagaatatgataaagattsstttaatgccatattaacattagcaggattaccaaattctcactataatgcgcaaaatttggagaatgaaaggataatttgtatgggaatgattattactgttgatggccctagtggtgctgggaaaggaacgctttgttatgcgttggctgaaaagttgggctatgcattgttggatagtggggcgatttatcgcgttactgcattggcagcgttgcaacgtaaaactgatctaacaaatgaaacagatttagcagaattagctcgtcatttagatattcaatttattcctcaaaatggcgaggtaagcattttgcttgcaggaatggatgtgagccgtttaattcgcacgcaagaagtggcagatgctgcgtcaaaagtagcagtctttcaaaaagtgcggtcagctttattacaacttcagcaagattttgcaaaaaatgatggattaattgcggatggcagagatatggggactgtggtattcccaaatgcacaagtaaaattatttttagatgcaagtgctgaagaacgtgcaaaaagacgctataaacagttgcaaaataaaggaataaatggtaactttgcacagattttagccgagataaaagagcgtgattttcgtgatagaaatcgtgaagttgcgccgctaaaaccagcagatgatgctttattattggatagtacaaccttgagtatcgatgaagttattgatcaggcgttagcttatattcaaaganaaggtatcagtttccgatttaactgtttgttcaaggaagaataagcatttatcctcanaccccgcattttatggattttaatgtggatgttattaacttaaattaagaagattatttatatgtcagaatcttttgctcaactttttgaagaatcattaaaagtccttgaaactcgtcaaggttcaatcgttagcggtactgtagtagctatccaaaaggctttgtgcttgttgatgcaggtttaaaatctgagtctgcaattccagttgctgaattcttaaatgcacaaggcgaacttgaaatccaagttggcgatactgtaaatgttgcattagatgcagttgaagatggtttcggtgaaactaaactttctcgtgagaaagcggttcgtcacgaatcttggattgaattagaaaaagcttacgaagaaaaagcgaccgttatcggtttaatcancggcaaagtgaaaggtggcttcacagttgagttaaacggtgttcgtgcattcttaccaggttctttagttgatactcgtccagcgcgtgaagcagatcacttacttggtaaagaattagaattcaaagtaatcaaattagatcaaaaacgtaacaacgttgttgtttctcgtcgtgcagtaattgaatctgaaaacagccaagaacgtgaacaagtattagaaaatcttgtggaaggntcagaagttaaaggtgtcgttaaaaacttaactgagtacggtgcattcgttgatcttggtggtgttgatggtttattacacatcacagatatggcttggaaacgtgttaaacacccaagtgaaatcgtaaatgttggcgatgaagttactgttaaagtattaaaattcgataaagatcgtactcgtgtatctttaggcttaaaacaattaggtcaagatccatgggcagcaattgctgaaaatcatccagtaaacagcaaattaacaggtaaagtaactaacttaactgactatggctgtttcgttgaaatcttagatggcgttgaaggtttagttcacgtttctgaaatggattggactaataaaaatatccacccatctaaagtggttagcttaggcgatactgtagaagtaatggtattagaaattgatgaagaacgtcgtcgtatttctttaggcttaaaacaatgtaaagctaacccttggactcagtttgctgatactcacaacaaaggcgataaagtaacgggtaaaatcaagtctatcactgatttcggtatcttcatcggtcttgaaggtggtatcgatggtttagttcacttatctgatatttcttggagtatttcaggcgaagaagctgttcgtcaatacaaaaaaggtgacgaagtttcagctgttgtattagctgttgatgcagtaaaagaacgtatctctttaggtattaaacaacttgaagaagatccattcaataactttgtcgcaatcaacaaaaaaggtgcggtagtatctgcaactgttgttgaagcagatgctaaaggtgctaaagttgaattagcaggtggtgttgaaggttatatccgttctgctgatttaacaagtgaagtagctgttggtgatgtcgttgaagcgaaatacactggagtagatcgtaaatctcgcattgttcacttatcagtgaaagcaaaagatcaagctgaagaagctgcggcagttgcaagtgtaaataacaaacaagaagatattgttattccaaatgcaatggctgaagcatttaaagcagctaanggtgaataattaattcacgtaatanggctgggctgatgtccagccttatttgttaggagttattgctaatatatttgtgtaatttattatcaatagatcttaatttaagtaatattaaggaagtatagacgatgactaagtcagancttatggaaaaattgtcagcaaaacagccaactttacctgcaaaagaaattgaaaatatggtaaaaggtattttagagtttatttctcaatctcttgaaaatggtgatcgtgttgaagttcgaggttttggtagcttttctttacatcatcggcaaccacgtttgggaagaaatccgaaaacaggcgattcagtaaacttatcagctaagtctgttccatattttaaagcgggtaaagaattaaaagctcgagtggatgttcaggcttaattgattaaaatttaattaaaatatttttgattaaaaagtttattttgggttacaaatattttacaggaaatgaaatgattaaatatattttaggtattgtgatctttattgctattgtgttagttgcaattaccattggtgcgaataacgatcagattattacatttaattatattgtggcagaaagtcagtttcagctttcaagcctcgttgctattttatttgggttaggtttaattcttggttggttaattactgcttttttctatattaagttaaaattaaaaaatatggcactagctcgtcaagtgaaacgtcagactttacaaatcaatgaattgacgactacgcgcgataaggtcgtttaatgatagaattactctttctattattgcctattgctgctgcctatggctggtatatggggcggcgtagtgcgaagaaagatcaagatgacataagtaataaactctcccgagattatgttacgggagtgaattttttactttccaatcaaactgataaagctgtagatttgtttttagatatgttgcaaaagcaagaaatcgaaaatgaaatcgaaagtcactcccaatttgaagcagaacttacacttggcaatctgtttcgttctcgaggcgaagttgatcgtgcattgcgcattcatcaagctttagatcttagtcctaattatacttttgaacaaaaattacttgcaaaacaacagcttgctcgagattttatggtggttggtttttttgaccgagctgagaatctttatattttactagtagatgaacctgagtttgcagaaaatgctttacagcaacttttagtgatttatcaaaagacaaaagaatggaaaaaagcagtcaatattgctgaaaaactcgctaaaataaagccgcaagagaataatattgaacttgcgcaatgttattgtgaatattcacaaagtttagagcctgaaagtgcggttgaaaaacgcagtgttttacaaaaggctttgtcggtttctccgacttgtgttcgcgcttctttattgcttgcaaatttagcaatgcttgacggtcaatatcaacaagcagtaaaaatattagaaaatgttttggagcaaaatccagattatacgggtgaaattttgttacctttaaaacattgttacgaagaattaaatcagttagataattttgagttatttttaattcgtgcaggtcaaattattaataatgatgaagtagagctggcactagctaaattaattgaagaaaaagatggcaagtctgctgctcaagctaagctttatcagcaactcacgaaaaagccaagtactttaattttccatcgttttatgcagtatcaaattgatgatgcagaagacgggcgtggaaaagaaagcttaattttattacataaaatggttggtgaacgaattaagcaaacatcgccttatcgttgtacaaattgtggttatcaaatccataagctattgtggaattgcccatcttgccgtcaatgggaaagtattaaaccggtttcaaatcaagaacataattaattgacactcagtgaggtaacattatgacaagtaaaattattgtggcattggatttcgagaaagaagcagaggctcttgctttagttgatcaaattgatccaagtttgtgtcgattaaaagtgggtaaagaaatgtttactacacttggtattaattttgtaaaacaattacatcaacgtaattttgatgtttttttggatctgaaatatcacgatattccaaatacggtagcaagagcagttcgttctgctgctgatttaggcgtatggatggtggatttacacgcaagtggtggcttgcgtatgatggaagacgcaaagaaaattcttgaaccttatgggaaagatgcgccattgcttattgctgtgacggtattaaccagtatggaagacttggatttattacaaattgggattaatgcatcgccaatggaacaagttttacgcttagctcatttaacccaacgggcaggtttggatggtgtggtttgctctccgcaagaagttgaaattttacgtaatgcttgtggagaagactttaaattagtgaccccagggattcgtccaataggaactgattttggcgatcaacgacgtgtaatgacacctaccgcagcaattcgtgctggttcagattatttagttattggacgcccaataactcaagcggataatcctgcggaggttctccgttctattaatgtatctattgggtaatcataaatgtcagattctgttttagtgtattcaacagatgtgggtcgaattaaagaggaaaaggcttctgtagttcgcccaaaaggagacggtgttgtacgtattcaaaaacaaacgagtggtagaaaaggtgctggtgtatcagttataactggtttagatttatctgatgaggaattgaaaaaattagctgctgaattaaaaaaacgttgtggatgtggtggagcagttaaaaatggtattattgaaattcaaggggaaaaacgagatttgctcaagcaattattagagcaaaaagggtttaaagttaaattatcaggtggatgattaaaaaggcgcattagtgccttttttgttagagattcaaaatttttttgacgaaaggaatcgtaagatttcgttgagcttgtaatgatgctttatctagtagatcaagtgcttcaaatagagtatgcatatctcgtgctagtcgtgtaattaaaaaatttgcagtttcgtcagataattggaatcctcgttggtaagctgcgagttgtagtactttgattttttgttcgtctgttaatgaatttaattgataaatttccccccaagttaagcgagagtttaaatcaggcaatttgacagaaagtgcggaaggcgatttatctgcactaattagtaaaagcgttttcccgcttgctttaattcgattaaacagatcaaaaatagctaattcccattcatcatttccgattacactttgtaaatcatctaagcatactaattcttgttgctctaaattttcaagaactgcggtagaaaaatattgagatttgctaaggggtacataaatagcagtacgttgattgattaaatattcgttactgaatgctctaagtaaatgggttttaccagagcctttatctccccaaatgtagaaaaacggttgttttaaatcagatgaatttttgcgtaaagaatcgagcaataaaagattattatcgccgtaaaagttctctaatgtagcatcatcaatttgatgaataggtaaggggagttgcttattcaaatgtttatgtagtacagattaagtaagaaagggctaaatgataatttaaccctttgaaatggggcttattctacttcattttttgctttcggtaaaacaaggtttaagatgatagcaacaatcgcacacaagctgataccttttagtgatacgttacccacatctacaaacatattgccgataccaaatgtcattacgacagaaataatacaaagattacgagcttcggtaacatcaacttttccgcgaattaaggtactcatgcccacaactgcgattgaaccgaaaacaagcatcataattccacccattacaatagttggaatggttgataggaatgcgcctacttttccacagaatgaaatcgcaatagcccaaactgcagcccaagtcataatatttgggttaaagttgcgtgttagcatcacagcaccagtaacttccgcataagtcgtattaggcgggccaccaactaaagaggcagcagcggtagcgatgccatcgcctaataaagtgcggtgtaatcctggtttttttaaaaagtctttacctgttacagagctgattgccataataccgccaacgtgttctacggcgggggcaatggcaattggtaacatataaagaatggcttctaggttaaattcaggtgtcgttaatttgggcaaactgaaccaaggcgcatcaatcactggttggaaattaattaaacctagaaataaacacaaaatatagcctgcggtaataccgaacattattggaataagtttcatcaatcctttggcaaatactgccacagataaagtggtaagaagcgttaccattgaaactaatactgcgtcgttataagcataggcactgtttttgcctaaggacatatccaccgcaataggtgcaagccccatgccaatgataataattactggcccaacaaccactggtgggaaaaaacgttgtaatgcttctgctccccgtaattttactaaagtgctcaaggcgaaataaacaagaccagtgaacgctaaaccgcccatcgtagtcgcaattccccaagtttgtacgccatattgaatgggcgcgataaaggcaaaagatgatgccaagaaaataggcacttgtttgcctgtgcaaaattggaagagtagggtgccaacgccagcggttaataatgccgtattggaatcaagtcctgtaattaatggcacgagtactagcgcaccaaatgcaacaaaaagcatttgtaggccaacgaaagattgttttaatttgctttgattttccgctagggaaggagggatttggtttgtcatttagtttcaactctctgtttgaattaacttaaaagtgcggtcagtttttcttgtgtttcaacgcacggaaaaaagacggcttaaatgccgtcttgttttggggattattttgtcccaaaaattttatcgcccgcgtcaccaagaccgggaataatgtaaccttgttcatttaaatggctatcaatagaagcgcagtaaagttcaatgtcagggtgtgcagcctcaagagctttaattccttctggtgcagcgactaacactaatactttgatatgtttacaaccttttgcttttaaaagatcaagggtggcaatcatagagccgcccgttgcaagcatcggatcgacaacaattgaaagtcgctcttctaaatcgctagctaatttttggaagtaaggaactggttcaagggtttcttcattacggtagatccccactacgctgatgcgtgcgcttggtacgtgttcaagtacaccatccatcattcctaaacctgcacgcaaaattggcacaaccgttacttttttacctttaattcgatcgatttctactggcccattccaaccgttgatcgttactttttcagtttctaaatcagaggttgcttcataggttaataggctaccgatttctgttgcaagttcacggaatttttttgtatcaatctcagcttcacgcatcacacctagtttgtgttttacaagtggatgttttacttcaaccagtttcatttttactctccttttgactcttaaaaaacaaattgacaaattctagattaaaaaaatacaaaatggtagaggtttataaaaatattctgacttgaaacgggagttttcaatacaatattgtctttaaactggtcgaatactctctacatctaattttgcatcaaactcattaagtagaatttgtaatttactatctttttgcaactcattttgagctttttcccgcaatgcttgataaatattgcggcgatattcaattggcgtcgtgacattgctatcatcaagattaattgttaatcgaatatctttaccttgtaatttgcttaatgcttcagctaaattttttatacttctgtcttggcgtaaatgggatttttctgaatgtagtccaagattgatttcatcatcggttttgctttgtaagaaacaatttaatgctaattctttgctaaatcctgttaagccagaacgctcaactatatctgcccactgatcttgttgttgagtttgggtaatgatttttaaacgtaattcaggcgtaatatcttttaaaatcgcctgttttatatcagaaggacaaacgcctgtatcggctttagcaagttctggattgctccattcccaacgataggtgtcagcactcaagatttcttgctcatcttgagcaatttctacattatcatcacttgaattttcttctgtgctatttttttgtggagcctgtgcggcatttgatggtaatgttggcttttctatgtgcttgggcttcggctcagtcatttctcgcacgggaagtgcggtcatttttttatgagatttttcttcgtctagttcttggatgtgatgtaaggtttcacttactacagctaatgattcagctttgtgttcttgacgttcttggttttccagttgtgttaaatgttcaagcgcatctaaagccgaaaggcttgccaaatttggaatgctcgttttatttggttttgcttgagaataagcagatttgatactttgcgacagtactggcacatcgacataattacccgtattttcaaccgcacttggcgttgatggcggtggagtaatagtggtgttagcctttggtactgccgtaaggaactttgggtggaatgccaatgccctcaataatgtcatctctgcaccaatacgacgatttggtgcatttgataaatcttttctaccagaaacaatgacttgataaaaaaactgaacattttctggagagatatgtttggctaaaaatgaaaaatgttcattgttatctgaagatttttgtggaagaagttgcataagcgcaatttgatgtaatttttctgcacattcgccaagtaatttatcccaatcgcctgccgcatcagcaactctttgtagtgttcgcattaagagttcgccattgccttgatgtaaggcgtataaaatatcaacagaatagttatcatcaagcaaccctaacatattgcttacaacattatttgtaacttgtcggtcgcccattgcaatggcttgatccgttaaacttaagctatcacgaatacttccttgcgccgcttttgcaagtttaactaatgcaggatcttcaaaaggaatattttcttgcgtcaaaatatgggcaagatgctgggagatttgagtttcatctaatgctttaagatgaaattgtaaacagcgagaaagaatagttacaggtagtttttgtggatccgttgttgcgagtaaaaattttacatattcgggcggttcttctaaagtcttgagcaacgcattaaatgaatgacgagatagcatatggacttcatcgattaagtaaaccttaaatctgcccacaactggtttatattgcacgttatccaataattcacgcgtgtcttcaacttttgtgcgagacgccgcatcaatttcaattaaatcaataaaattgccttgctcaatagctttacaattttcacattcgccacaaggcgttgccgttacaccgtgaacacaatttaatccttttgcgaataatctagcaatagaggtttttcctacaccacgcgtgcctgaaaagaggtaagcgtgatgtagtcgattatcttttaatccatttgctaatgccgtgataatatgttcttgcccaacgacatcagcaaatgtttttggtcgccattttctggctaagacttgatagctcatcgaatccttaattaatgaccttcaaaattgacgagtgtatagcaatcaacgcccaaattatttaagcgtttttcgccacctaattcaggtaaattaatcacaaatgcagcgtgttttaccgctccacctaaacgttgcactaattttactgtcgcttcaactgtgccaccagttgctaataaatcatcaataattaaaacattgtcaccttctgaaattgcatcaacgtgcatttccaaagtatcttgaccatattctaattgataagattgcgaaatagtctcacgtggtaattttttaggtttacgtactaattcgaaaggtaaacctagtgctaaggcaacgggggcaccaaaaataaaaccacgagattcagttccaagcactttggtaattcctttatcgcgatattgttccacaataagatctattgttgctttaaaagctgctggaacttctaaaagggtagtaatgtcgcggaagataatgccttcttttggatagttaggaattgatttgatagaagatttaattaaatcaagttgtgtagtcataaataatgctcaaaagtgcggtaaaaaaagaaacgtttttagattggcattctatcataaaaaaatagaaagagaggaaaataaaaatccccaattggggatttttatttaagtttgaatttacaatttaagatgaattaaaacttcttaaatagaaattattttttccttcgcttttgcatttggaaggtcagtaattgagccttcaaatacttccgcagctaagccaacagactcgtgtaaagttgggtgagcgtggatagttaatgcaatatcttctgcatcgcaacccatttcaatggcaagaccgatttcgcctaataattcaccaccgttagaacccactattgcaccgccaagtacacgatgtgtatctttatcaaagattaacttcgtcataccttctgaacattcagatgcaatcgcgcggcctgatgcagcccaagggaatttagccacttcgtagtttaagccttcttgtttacattctttctcagttttacctacccacgccacttctggttcggtataagcgattgatggaattactttaggatcgaagtagtgtttttgtcctgcaatgacttctgcggcaacgtgaccttcgtgaacacctttatgtgctaacattggctgacctacaatatccccaattgcgtagatatgtggcacgttggtacgcatttgtttatcaacgtgaataaaaccacgatcatccacttcaacacctgctttacctgcatcaattaatttaccatttggcacacgaccgatagcaacaagcactgcatcataacgtttggtatcattacatgctttgccttccattgaaacgtagataccatcatcttttgcttcaactgcagtcactttggtttcaagcattaacttgaattttttctcaacttgtttagtgtaaataccaacaacatctttatctgctgcaggaatcacttggtcgaacatttcaacaacttcaacttcagaacctaaagcattgtatacagtacccatttctaaaccgatgataccaccgcccataataagtagttttttcggtacttcttttaatttgagcgcatctgttgaatcccaaatacgaggatcttcgtgtgggataaagggtaattgaactggacgagaacctgccgcaataatggcattgtcgaatttaacagtcgtagggtttccatcgcgatcacgcgcaactaatgtgtgagaatcggtaaaagtcgctaaaccttcaacaacagtcactttacgtgcttttgccattcccgctaaaccgccagttaatttagcaacaacagcttctttacctgcacgtacttcatctagctcaatgcgtggttcactaaaataaataccatttttattagcatgctttgcttcttcaattacttttgcaacgtgtaataacgctttagatggaatacaacctacgtttaaacacaccccacctaaggttgaataacgctcaacaataacagtttctaatcctaaatccgcacaacggaatgcggctgaataacctgcaggacctgcaccaagtacaacgacttgggttttaatttctttactcatttttacctcgtaaaaacgttaaaaatattgaccgcacttttacggtctttataggatgggtttctgcccaccaaagatttcattaatcggtgggcttaaagcccacctacagattacattactaagcgacgtaaatctgctaaaacagagccaagatagctaatgaaacgagctccatctgcaccatcaatgacacggtggtcgaatgataatgacattggaagaattaagcgtggcgcaaattctttaccattccatactggttccattgatgatttagacacaccaaggatagctacttctggcgcatttacgattggtgcaaagtgcgttgtaccaataccaccaagacttgaaatggtgaaacagccaccttgcatatcagatgcagtcaatttgccttcacgggcttttttcgatacttccattaattcacgtgaaagttcgataatgcctttcttgttcacatttttgaatacaggcacgactaagccattcggcgtatctactgcgacaccgatgttaatatattttttcaggattaagcgttgagcatcttcggtaattgagctgttgaaacgtggatacgcttctaatgcttttgccaccgctttcataataaacacaactggcgtgatttttacaccgagtttttgtttttctcgtaacgcattttgttctttacggaatgcttctaaatccgtgatatctgctttatcgaagtgagtgacgtgtggaattattacccagttacgatgtaagttagcacctgaaattttgttgatacgacttaattcaacttcttcaatttcgccaaatttactgaaatcaacttttggccatggcaataagcctaagccagcaccatttgctacaccattgccagtagcttgtgctgttgcaccgctttcataggctttaactgcggtcttcacataagcttcaatatcttctttaacgatacgacctttacgaccagtaccttttactttatctagatttacaccaaattcacgagctaaacgacgaattactggtgttgcgtgtgcatatcctgtacttgcttctacttgttcttggcttaatccagatacgttgttatttgattgagctgcttgtgcagtagtatcaggagctgctgcctgtggtgcttgtgcagtagtatcaggagctgctgcctgtggtgcttgtgcagtagtagcaggagctgctgtctgtggtgctgatgttgaagctggagctgatgctgattctgctggagctgcacctagtacttcaaaacgcataattaatgaaccagttgaaactttatcgcctgatttcactaaaatttcttttaccacaccgccgaatggtgcaggaacttccattgaggctttatcgccttcaacggtaattaaagattgttcttcagtgattgtatcgccaactgcaaccataatttcggttacattgacttcatcgccaccaatatctggcacatttacttctacaatagctgaagccgttggtgcggtagcaaccactggtgcagtaggcgcatcagctactggagcagtaggctcatcagctgctggagcagcacctgccgcttctaatacaagcattggagtaccagttgaaactttatcgcccactttgactaaaatttcttttacaacacccgcttctggtgcaggcacttccattgaagctttatcgccttcaacgttaatgatagattgatcaacagaaatggtatcgcctacgtttaccatgacttctgttacggtaacttcatcactaccaatatcaggaatttgaatttgttttgacattttttgttccttttaaagtgcggtcataaaacacaatgttttttgaccgcagttttcatcaattacgcataaagcggattgatacgatctacattcaaaccgaatttcgcaatcgcatctgcaaccacttggttagatactgtaccttctttcgctaattgagaaagtgcagcaaccacaacataacgtgcatcaacttcgaagtgttcacgtaagtttgcacggctatctgaacgaccgaaaccgtctgtacctaatacatgatagtgcttacttggtacaaatgcacggatttgatcagcataacctttcacatagtcagttgaagcaacggttggtaaatcagctaatacttgagcaacgtatggtacgcgttgtgtctctgttgggtgtaataagttccaacgtgctgcatcatgaccttcgcgtgctaattcattgaatgaaggcgcagaaaatacatctgaagtcacaccgtagtcatttgcaagaatttgtgccgcttcacgaacgtgacgcataatcgcaccagaacctaataactgaacgtgacctttgccttttttaccttccactgtttcaaatttatataaacctttacggataccttcttccgcaccagcaggcatcgcaggttgatccatcacttcatttaatgtagtcatataatagaacacatcttcttgtttttcgccgtacatacggttgataccgtcttgcataataacagcaacttcaaatgcaaatgatggatcgtaagtgatacagttaggaatgatacccgcttgaatatggctgtgaccgtcttcgtgttgtaaaccttctccatttaaggttgtacgaccagaagtaccccctaccataaagccacgagctaattggtcgcctgcagcccacatcatatcgcccacacgttggaaaccaaacattgagtaatagatgaagaatggaatcatcggttggttattgacagagtacgagttcgctgctgctaaccaagatgcggttgcacctaattcattgataccttcttgtagcacttgaccatcttttgcttcacgatagtaagccactaaatcacggtctgaaggtatatagttttgaccatgtgggttataaataccaacttgacggaataaaccttccataccgaaagtacgtgcttcatccgcaatcattggaacgatagttttaccgatgtttttatcttttaataagatgtttaatgcacgagtaaacgccatagtggttgaaataccacgaggttgttcttctaataatgctttaaactcttctaatgcaggaactttatattcaacatcaaatttagtacgacgagcaggaacataaccgtttaatgctttacggtgaccatgtaagtattcatactcaggtgtgccttcagcaaatttaatgtattctaatttttctacttgttcatcggttaatggtaattcaaagaagtcacggaaacctttaaggctttcgtaagacatttttttagattggtgagcggtatttttactttccgcttcaggaattttataacctttaacttgatgcgctaaaatcacaactggtttcgttgcattttgtgcttttgcataggccgcatataatttttcgctatcgtgtgcaccacggcgtaatgcccagatttcatcatcggtcatatcagcaactaatgcagcagtttctggataacgaccgaagaagtgttcacgaatatatgcaccatctttagatttaaaggttaaataatctccatcaaccacttccatcattaactgagttaatttacctgaagtatctttcgcgaataatttatcccaatcgctgccccataaaactttaatcacttcccagccagcaccagtaaatagcccttctaactcttgaacgattttaccattaccattcacaggtccatctaaacgttgtaagttacagctgatagtgaagattaagttatctaagtgttcacgagccgcaaaagttaatgcacctttagactcaatttcatccatctcgccatcgcctaagaacgcataaactttttgatctttggtatcttttaaaccacggttatcgagatattttaagaaacgcgcttggtagatggcattcacagggcctaaacccatagaaaccgtagaaaattgccaaaattcaggcattaatttaggatgtggatatgaagataaaccgtcggtaaaggcttcttgacggaagttatccatttgttcttcagttaaacgaccttctaagaaagcacgcgcatacataccaggagctgcatggccttggaagaaaattaaatcgccaccgtttttctctgttgcagctttaaaaaagtggttgtagcaaacttcatacattgttgctgcagattggaaagtggaaatatgcccacctaaatcaagatctttcttctgactgcgtaaaaccatcgcgatcgcattccaacgtactgctgaacgaatacgacgttcgatagcgtgatcacctggataagcaggttgctcagccacaggaatagtattcacgtaatcagtggtaactcctgttggcaatgaaacaccacttgtacgtgcttgaccaataacttgctcaacaatatattgagcacgctcaacgccctcttcacgaattaatgaatctaatgattgcaaccaatcttgtgtttcgattggatcaacgtcattttttaaaatctcagacataggttttccttaatctgttttgagtgaatattagtttagacaaggctaaacacgaatacggcaatatttgcttttcacaaacatttaacaaatcttgtaaattttagaagattttttgagataaagatagtgaattttcatcaaatcatcatatcaaatcagctttgccataaataattatttgaaagtgcggtaatttttttgtgtttttttgttcgctaaaataaccagtaaaatattgcattccatcgggctttgttttaaagttttttcagatttttttcaaaaaggactcagcaatgcagacaacaactcgaaccctcactcaacacaaacgtattgcacttgtggctcacgatagttgtaaaaaaaatttactgaattggacgcaaaaacacaaagaggcacttaagcctcatatactttatgcaacaggtacaacagggcatattttagaacgagaaacaggtttaagcattcaatctttattaagtggcccgatgggcggcgatcaacaacttggtggattaatcgcagaaaagaaaatcgacatgatgatcttcttttggganccaatgaatgctgcaccacatgaacctgatgtgaaagcccttatgcgtattgcaacagtgtggaatattcctgttgcgattaatcaaagctctgcagattttcttttaacttcagttttatttgaacaagatgtggaaattgacgtaccagattatgaagggtatttaaaagagcggttagcttaaactgcaacgaaaatttaccgcactttatagttgtaggtgggctttagcccaccaattaaccataaaaaatggaataaaaacggtgggctgaagcccaccctacgatacttttaattaaatacaaaacagggcgacaatttatcgcactgtttcagttatctcccaaatccccccattacaagtataaagagtaccactttcaactgtncttctgggattggcttgccgtttagtttcaagtcgttattttctagagcaagcgttaatgttacggttttgtccgtgtttacgataatgccattngcttcgccttcagcaattaattcgtccattctgtaaactaaatcttgcttttggttttctggtacaaatttagataacaatgaaatcgcagtttctttgttcacatcaaaattgatcgaaaaatctttgaattgtttgtataagccactgtgcattaaatcaaatttaggatttggcactaaagcaatatttagatccaatgccactttgcctttttcatcagaaatagaaagaggggtaaacttaatttgaggctgattattcgcaatggccatgcctgcttgttgtaatttttgcaccaatgttttagatagaggcattctgagtcggctttgcctatagcaactaaaatatttaaaagttcttgtaatgcgttgccatcaatatggttgaattctacattgttggtcactttacctaagttgttaccgttaatatgtaattcatccagatttgttttattgatgatatttactgtatcaccctcaacttgtgtagttaaatttgcttggctgtttttctgaataagagagaatttttcgccactctctgcagattcggtattttgctcaaaatagcctattttactattgatattcccactataaataaatggccattttgtgctttgcaacgagccttgtacgacaagatcttttattttaattgatgaagcggttgaaactgcatgattaggggcatttgaattaaatgtatcgacagatagcacatagttatttggtgtattttggtttaaatcaatatttaatacgacatttgaccaatcaaaatctgtcttagattgctcattgtgatattgccccgatgcaagttttaattccgcattaccgcttaatgaataattcattgcgaaattcagttgtaacggtttctctgattctgtgatatcaaagaatgcctgagttgttgcattttttcctaacaatgtttggcttgaaaaaatggctggaacgaaattcagttttgccacacgatcaagcggcaaaggcccgtgataaagtgttgatgataaaggaataatgatcgtttcatttgccttgtgaatttctatttgatcttgaatgtgagaggcaaataatcctctttcaaattttatatttttataaaaaattttactttcttctaatgcctcagttttggtaaatagttgatttaactgttctagttgatataaatattcttcttcagcttttttccctgtaaaccatgcacttgtgcaccaaacggcagcaagagcaaccactacgcctgcagcaatttttgattttttcatttatttctttcctattttaaagtaaaaattttcgccaaatttatcacaaatccctttttcttgcctgaaaattttgttttccccttgaagttcatcatttgagacttattttgaaaaacaagaacggaaattaccgcactttaagaaataaaaaatttttaaaattttctcttgaaatgcgaaagaatatccacatcttacaattcgtaataaataggtctaaaagccctaccccgaattttaaaatttttactaggagtacaaaatgggaaaaattattggtattgacttaggtacaacaaactcttgtgtagctgtaatggacggcgataaagcgcgcgttattgaaaatgcagaaggggcacgtactactccgtcaatcattgcatatacagataatgaaaccttagttggtcagccagcaaaacgtcaagcaatcactaacccaaaaaatacattgtttgcgattaaacgtttaattggtcgtcgttttgaaagtgaagaagttcaacgcgatattaaaattatgcctttcgaaattactcgtgccgacaatggcgatgcttgggtaaacgtgaaaggtgataaattagccccaccgcaaatttcagcagaagtgttgaaaaaaatgaaaaaaactgcagaagatttcttgggtgaatctgtaactgaagcagtaattactgtgcctgcatacttcaacgacgcacaacgtcaagcaacgattgatgcaggtaaaatcgcaggtttagatgttaaacgtatcattaatgaaccaacagcggctgcgttagcgtttggtttaggttcaagcaaagagaaccaagtgatcgctgtttacgacttaggtggtggtacatttgatatttcaatcatcgaaattgataactttgatggcgaacaaactttcgaagtattggcaaccggtggtaacactcacttaggtggtgaagactttgataaccgtgtaattgattacattattgatgagttcaaaaaagaacaaaatatcgatttacgtaatgatgcaatggcattacaacgtgtgaaagaagctgcagagaaagcaaaaattgaactgtcatcagcgcaatctaccgaagtaaacttaccttacatcacggcagatgcgacaggccctaaacacttagcattaaatatcactcgtgcaaaattagaagcattagtagaagatttagtggcaagctcaattgagtctttgaaagcggtattaaaagatgcagataaaggtgtaagcgaaatccacgatattattcttgtgggtggccaaactcgtatgccacttgtacaacaaaaagttgctgagttctttggtaaagaagcacgtaaagatgtgaaccctgatgaagcggtggcaatcggcgcggcagttcaaggtggtgtattaaaaggcgatgtgaaagatgttcttttattagacgtaactccattatctttaggtatcgaaaccatgggcggtgtgatgaccactttaattgagaaaaataccacgattccaactaaaaaatcgcaagtattctcaacagcagaagataaccaaagtgcggtaactattcacgttcttcaaggcgaacgtaaacgtgcggcagacaataaatctttaggtcaattcaacctagaaggtattaatcctgcgccgcgtggtatgccacaaattgaagtaacatttgatatcgatgcaaacggcgtaatcaacgtatcagcaaaagataaaaatacgggtaaagagcaacaaattcgtattcaagcatcatctggtttatctgatgaagaaattcaacaaatggtgcgtgatgcagaagcaaatgctgatgcagaccgtaaatttgaagaagttgttcaagctcgtaaccaagcagatggtattgctcacgcaacacgtaaacaaattgcagaagctggcgatgcattgagtgtcgcagacaaagagaaaattgaagctgcagtcgctgagcttgaaacagcagcaaaaggcgaagataaagcagaaattgaagcgaaaattgaagcagtaattaaagcctctgaaccattaatgcaagcagtgcaagcaaaagctcaacaagctggtggcgagcaaccacmacaatcatcagcaaaagatgatggcgtggtagatgctgaatttgaagaagtgaaagataataaataattcaccgctcttcttagcataaacaaagggcgtggaaacacgcccttttggtgtatttattttcagcaacaaattacaaaattactatggcaaaaaaagattactacgaagtccttggcctacaaaaaggggcgagtgaggacgaaatcaaacgtgcgtataaacgtttagcgtctaaacatcaccccgataaaaaccaaggcagtaaagaagcagaagaaaaattcaaagaaattaatgaagcttatgaagtattaggcgacgatcaaaaacgcgcagcctacgatcaatatggccacgcagcctttgaacaaggtggtggcgcaggtggcttcggtggcggctttggtggtgctgattttggtgatatgttcggtgatatttttggcgatattttcggcggtggtggacgtggtcgtcagcgcgttgttcgtggcgaagacttacgttatgacttagaaattagcctagaagaagccgtaaaaggtacaaccaaagatattcaaatcaatactcttgcacattgtgatagctgtggtggctctggggctgaaaaaggttctaaagtggaaacttgtccgcattgccacggttctggtcgaattcgtcgtcagcaaggtttctttgtatctgaaagtatctgtccaacttgtcatggtagcggtaagaaaattgaaaaaccttgtcgcaactgtcatggagaaggacgagttcataagaaagaaaatctttcagtaaaaattcctgcaggcgtagatacgggcaaccagcttcgcttagctggaaaaggtgcagcaggtgaaaatggcgcaccagcgggagatttatatgttgtgattcacgtgagagaacataatatttttgaacgtgatggctctaatctttactgtgaagtaccgattagctttgctactgcagcgcttggcggtgaaattgaagtgccaactttagatggtagagtgaaacttaaaatccctgctgaaacgcaaacaggaaaattattccgcatgcgaggcaaaggtgtcgcttctacacgtagtggttatgcgggtgatttaatttgccgtatcgtggtagaaacgccagttaatttaaccagcgaacaaaaagaattactccacaaacttgaggaaagtttacaaggtaaagatttaagtaaacatgcaccaaaatcttcaggatttttagacggtgtgaaaaaattctttgataatttgggtaaatctgacaaataaagataatgaaaaagtccgcatttcgcggacttttttatatgcaaataatctcttctaaaaattaccgcactttaggttttatttgcggacagtatattcgccttcacaaacccatttataactggttaatgcttctaatcccattgggccacgagcgtgaagtttttgggtactcacggcaacttctgcgcctaatccaaattgtccgccatcagtaaagcgtgtgcttgcatttacataaacggctgccgcatcaacttgattgataaattgacgggctaggctttgtgaggaagttaaaatactttcagaatgttgcgtaccatattggcggatatgctcaatagcggcatgaatatcttccacaacaaccacattcaaatccaatgatccccattcttttcgcaattctttttctgtcacttcgcagacattcgcacccgcttgtttcaatatattaagtgcggtggattttgcatgatattttacgtttttagcggaaaggtgagagacaagtttaggtaaaaattcttcagcaatagaatgttgaactaacaatgtttccaatgtgttacaggtgcttggacgttgggttttggcgttatcaataacaaaaatcgctttattttgatccgcacttttttcaacgaaagtatgacaaacacccacaccacccacaataacaggaatagtcgaatgttgtttacacaattcatgtaaacccgaaccaccacgaggaataatcatatccacatagcgatccagttttaataattgcataacgagttcacggtttggatcggtaatggcttgcaccgcaaattttggtaagcctgcttgctctaaagcattttgcacaacttcgattaaaatcttgttagaaaactgtgtttctttaccaccgcgtaaaatcactgcattacccgttttaaggcaaagacttgccacatcaatggttacatttgggcgagcttcataaattgtaccaatgacgcctagcggagtgcgtacgcgttcgattttaagtccgctatccaatgtaccgccgtctatgattttccccacgggatctgctagagaaataacgtggcgtacatcattagcaatgccttgtaaacgttcttgtgtgagcagtaagcgatcaatcaaggcatccgataatccattttgtttggcaagttcaatatcttttgcgttttcggctaagataagcggtgcttgttgttcgagttgttctgcaataatggataatgcacaatttttttcagcagtggtgagttgagccaagataaatgctgcatctttggcttgtttacccatttgttctaacatagttattccctttattgtatttatttctttttatttggctgcttatcttgttcttccgatgtgagttcttggtaattaaacaccggcaacccccattcgaaatgaatagctaaaaggcgtaaagtaaagctgttaataagtgtgagtaacacggcaagtgtatgttctacttgaagtgtacttaatgcgtaataagtcagcgtggcaaatagcgcaatgctggcatagagttctttttggaatacgagaggaattcgattgcatagcatatcgcgtagaaccccgccaaaggcaccagtaatacagcctgcaatacaaacaatggtaaggctatgtcccatatccattgcaatttgtgcgccaataatggaatacaccactaagcccatcgcatcaagcaccaagaaaatagtgcgaaagtagcgcataaaatgattgataaatggtgcaacatatacggtaattaccgccgcacttgccaccattaaaaaatattctgggtgcttaacccagccgagagggtaatgcccaagcagtacatcacgcacagaaccgccaccaatggcagtgacagatgcgataatgatcacgccaaaaatatccattttttcacgacctgccgcaagtgcgcctgtcattccttcagcggtgataccgatgatatataaaatactaagtaacattcatgtacctaagtgcggttaaaattggtttcattttactttaaaatttaatgaatttttagcataatggcgcattattttttcagacgtcaaaattatgtcagaacaatcttctaaatatatcgcagcattgcttgcggtattatcgatctcaatggtgcttggcatcgatctatttattttttctttgcaatctgaaaagcaaacaatgcctcatttaggtgtaggcgtgttggttgcacagttaatttcgttgttggtgttttatcgtggcgaaatttgcccaggacaacgtggtcgtttaatcaaagtgaatatgacttttgctatttattgggcagtgtggttgctgataagcctattacaaaataatcacacgcttactaacgtgatgagcgtatgtggtctttctgtcgtgtattttatttggaaacaacccaaaactgaaaaaattcgtaacagctttttattgatggctgcattaattgcgggtttaggttgcttgagttatttaatgatttttaccgagcttcctgcgagtgattttgctgaatataacccttttgcaccaattttatctggcgtgattttggcaaatcttgtgcttgttattgcangaaatcgtttacaaggttttatagcattgttgcccttagcaatgattatattgcttgctctaaatgctttggcaatgtttttatttttacttttaaatggtatggaaagtgcggttaattctgagagtgtttttgcctacatcatttattttgtttgccattttgtgattgcggctattctgattctgcatagtttccaaaagtggacattatctaccaatagtttatttatcctattatttattgctgtttgcttgccgttatggatggtttttgtttaataaagaaaacaatcattgcgccgtggggaatttatccacggcttttaagatttcggctggttagaaagtaatacgccaacacggaaatcacgacacatgcccccatagtaaagagcattggtgcggcagtatccattttcattgacgcgactaaacttcccataattgcacccactgcaaaacgtacgctaccaatcaaagaatttgctgttcctgccatttgaggacatctttctaaagctgatgccattgcatttgatgaaatcactgggtttggaccgacgaaaaaggcgacgccaattgccattggccaaaaaccgagatctaaaagtgcggtcaaaattagccacattccagaaaggaattgaattgcgagggctatccgtaacattgtttctgcacccactttagtaacaaatcggctatttaaaaaagaggcaaagatcatcgtaacgatattcatcataaagaaataaccaaactgatcgacgggaacgccataaatgccgatatagacaattgatcctgcagtcacaaaagcaaacaatccaccaaagctaaaagaggcggcaaacatatagccaagcacttctttttgcttccaaagcagaaggaaattgcgagcgataatatttaagcgcagcggaatgcgattttcttttttatgggtttctggaatgatgaaaaagaccaatgcagcggctaataatcccacgagcgaaataacgtaaaaaatcgcatgccaatggaaaaatttaacgatgtaaccaccaatgattggtgcaactaaaggtgcaagcataaatactaacgtgatggtggacatcactttggatagctgatctttactaaataaatcacgcaataatgcgccagaaagtacaacaggtgcggcaccaaagaaaccttgcacaaaacgaagtgcggtaaaatttccaactgaatttatttcggtaagcactaaagctgttaatgcgcccacaataacaccgagtaaaatgatcggttttcgtccgaaactatcaccaaaaggcccccaaaaaagctgaccaaacgccatgccataagcaaaagaggtgagcgtgtgttgtacttgttctggacttacgtcgagatcctttgcaatttctaaaaaagacggcaaatacatatccacgccaaagggcggtagcatagagagaataccgagggtaagaataaagatgaaagtcgatttttgttgattcatattattttactaacttttcaatttcactttgagttaatgggcggtattcgccttcttctaaggattcatccaacactacatcaccaattttccagcgatgtaatccaacgactttattcccaagtgcggcaaacatacgttttacttgatgataacgaccttcagaaatggtcagattcacattgtagtcatctaaaatttctaattttgctggtttagtgggctctttttctccgcgtaataaaatgccttctgcacaagctgctgaataattttcttctacgggatcagctaatgtcaccaaataggttttttcacaatgatgctttggggaagtgatgcgatgtgaccattgtccatcatcggtaagcaatacgagacctgtcgtatccacatctaagcgacctgcgctatgtaattttccagctaaagggtaatcaaaaaattgataaattgttggatagtcgccgtcatcattagaacaaacacagccttgtggtttattcaacataaaatactggccttcttcgatccaagttaataattcatcttcaaaataaatttcgtcttcttgtgaaatttgaaccgaaccacttttgacaatttcaccgttgatttttaccgcactttggcggatcgcttttgttgcttgagaacgagttaatcccacattttcagcaataaatttatctaatctcattatgttttctcttattaaaattcgctaggcattttacaggtttttgcttttagaacgaaacaaaaaaggctgcaatgcagcctttatctattaagcgtggttaaaccacttcacgtaatcgaattgatcgtaatattttttcccattccagccagaaaattcaaaaatatcgcccacttgattttgcttctcgaagccttttatataataagccgatttaaaagctggatagggcttgtgagtaaaaatcactttatttttgaaagggagttgatcaaaaagttgaatgtctttttcggtcacgccgtctcgatctgtcatcataataaaaagattgtctaacttcattcgtgacgtgcgaagttgccatttttcattggcttcttgctcactgtgataatgcataaaatgaatttcaagatcggcaagttttcccactggataacttttttctgtttgtacgaatgtgagaggttgagtgaggtaaaaatctatattttgtaaataacgcaaaaaatcctgtggcgagagatagagattcacaaaaggggaattaaacggctggtgtaaatcatgtaagataaaagcccccacgcaattggcagaaatgacagtcataccttgatttgttagtttacgttgcagagtgcgattaatgaaaaatctttggcgtttattcaccgcacttttaattttttgaaatggattcattttctcatcctttatgcttttgttgcgaaaatcctaccttttttgctgaaaaatgaaaagtctagctaatgcctcgcatcaaaaaaattttgttataaagttgtaaaagtttgcagttcgtcacaattttttgaataaaaaacagatataatcgacgcaatatttcaatcctgtttcaagaaaatggagcacttattatgaccgaacaattacgtcaagcagccttagatttccacgaatttccaattcctggaaaaatcgaagttaccccaacaaaatcattagcaacccaacgtgatcttgccttagcttattcaccgggtgtggcagagccttgtttagaaattgaaaaagatcctgcagcctcttacaaatatacagcacgtggcaatttagtggcggtgatttccaatggtacagcggtgcttgggcttggcaatattggcgcgcttgccggcaaacctgtaatggaaggaaagggcgtgttgttcaaaaaattcgcaggcatcaacgtgtttgatattgaagtgaatgaacatgatcccgataaacttgtagatattattgcctcgttagagccaactttcggtggggtaaatcttgaagatattaaagcaccggaatgtttctatattgaacaaaaattgcgtgagagaatgaatattcctgtattccatgatgaccaacatggcacggcgatcatcagcgctgccgcgatcatcaattctcttcgtattgtaggtaaaaaaattgaagatgtacgcttagtggcttctggtgcgggtgctgcatctattgcgtgtttgaacttattgctttctttaggtatgaaacgtgaaaacatcacggtttgtgactcgaaaggcgtggtatataaaggccgtgatgacaaaatggatcaaaccaaaaaagagtatgcaattgaagataatggctggcgtaaacttgctgatgcgattccaaatgcagatattttcttaggttgttctgcggctggtgcgcttacacaagatatggttaaaagtatggctgcgcatccaattattcttgctttggctaatccaaatcctgaaattaccccgccagaagcaaaagcagttcgtcctgatgcgattgtatgtacaggccgctctgattatccaaaccaagtaaataacgtgctttgtttcccatttattttccgtggtgcattagatgtgggcgcaaccactattaatgaagaaatgaaacgtgcggcagtttatgctatcgcagaccttgcattagaagagcaaaacgaagtggtaacctctgcttacggtggcgaaggggcaacatttggtgcggattatgtgattcctcgtccatttgatcctcgcttgattgtgcgtattgcaccagcggtagcaaaagctgcaatggaatctggtgtggcaactcgtccaattcaaaattgggatgcttatgttgaaaaactcactcagtttgtttacaaaacgagcttgtttatgcgtcctattttcagccaagcaaaatcggcaaaacaacgcattattttagcggaaggggaagaaaataaagcattacatgccacccaagaagtgatttcaatgggcttggcaaatccaattttaattggtcgccgcagcgtgattgaagaaaaaattaaaaaacttggtttacgtttaactgcaggtgtagattttgaaattgtggataacgaagataatcctcgctatgaagaatgttggaaacactattacgaacttactaaacgtaaaggcattacacctgcaatcgcaaaacgtgtcgtgcgttctaacaccaccgtattagcttctacattgcttagcttaggttatgcagacgctttagtatgtggcttatttggttcatacggaaaacaccttgcctctattcgagatattattggcttaaaagacggtgtgaaaactgccgctgctttaaatagtcttgtattaccgacgggtaacgtattcttaacagatactcacgtaaacagtaatcctacagcagaagaattagctgaaattaccttaatggcagcagaagaaattcatcgttttggtattgaacctgcagttgcattgctttctcattctaattttggttcatctgattcattaggcgcaccaaaaatgcgcgaagtattacagatcgtcaaagagcgcaatccacatttaatgattgatggggaaatgcgtggcgatttagcgatgaatgaagcacacagaaaagaattaatgcctgatagcccattgaaaggaagcgcaaatttattagtgttccctgatttgagtgcatcacgtattagttatagcttattacgcggcactactacggcaattaccgttggcccgatcttaatgggaatgaataaatctgcgcatattcttaatccaggtgcatctgttcgtcgtattatcaatatgattgcctatgcagcagtgaaagcacaacaagagtaattaaaaaagtgcggtgaatttctgtcgtttatttaatgaagcctcgatttttctcgaggctttattttctagtgaatgtgtttacatttgagattaagtaaaactatgcgaaaatttaccgcactttaagacttttgtcgtgtcgaaaaggaaccgaccgatagacagttgcctatctttctttaatttaatacggcttggatgccgttgtgttagtggtttttacaatgaaaaaagcacattcccctttattccccatcttcacattcgtgttgattaatctcattatcctttccttatcccgtttgggacttgctgtgtggcaatcagagcgtgtatccgccgtagatggctggttgcaattatttttgcaaggcgtacgaatggatgttgtggcactttgttatttatttggcgtaccagcattgctcacaacattgttccatagcagtaaagtttgggtaaaaattttacgcctatggctaacctttggtagcgtgttcattatctttatggaaattgccacacctgcctttattgaaacctatgattaccgaccaaatcgtttatttatcgaatacctgatttatccgaaagaagttttttcaatgcttgcggaaggacatttaagtgcggtgatttttagccttgttttcacgattttagctgccgtgatttattggaaaatttctggttgggcagtcaaaaatttacgttcaatgagttggaaacttcgccctgtgattgctttgcttgtgattgtcgtgagcttccttggggcacgttcaagttttcaacaccgtggtataaatcctgctatggtggcattttcttctgatgcgttagttaattctctggtgcttaattcgggctattccgtcatttatgcggcacagcaatttaaagatgaagaaaaatcttcagaaatgtacggaaaaatggatgcagatgaaatgtttcgtattgttaaagccagccgtggccgtccagaaagtgattacatttcagataaatacccaactttaacgaaaaatgtcgcgacttatcagggtaaacctaaaaatatcgtgattttgttacaagaaagtctcggtgctcaatttattggaacactcggtggcaaaccactttctccaaatgtggatcagctcgcaaaagaagggtggttatttgaaaatctttatgcaacaggcacacgttcagtacgtggtattgaagcaaccaccgcaggttttacgccaacaccagctcgtgcagtggtgaaacttaataatgcccaaagtggtttctttactattgcggatttattacataaacaaggctataacacttcgtttatttatggtggcgaaaagcacttcgacaatatggcgagctttttctacggtaatggctttaaagatatttgggatcaacaagactatcagaatccaaaatttactggcacttggggcgtgagtgatgaggatttatttgataaagccaatgaaactttcacgaaattacaaaatgaaggtaaaccgttttttagtttagtatttagctcaagcaatcacgawccatttgaatatccagatggcaagattgagctttatgagcaaccaaaagccactcgtaataatgcggcaaaatatgcggattatgcgttaggtcatttctttaaaatggcaaaacagtctaattattggaaagatacgattttcttaattattgcggatcacgattctcgtgtaggcggagcaagtcttgtgccgattaagcatttccatattccagccttgattcttggtgatggcattacgccacgtcgtgacagccgtcttgtgagccaaattgatatgccaactacattgctttctttagctggcgtaagtggcaattatccaatgattggttttgatttaacgcaagatgtaaacccagatcgtgcttttatgcaatacgatcaaactcaagcaatgatgaaaggcaataatgatgtggtaattcaaatgccaaataaagcagcgcaaggttatcattatgataaatcaacagaaactttaacgccaaaagacgtacctgatgcaatgaaaaaagaggcattggctcacgctttattaggtagttatttatataaaaatcgcttgtattcttcaggtgaaaataaatagacagaacgccagcttaagctggcgtttcttttagttatcaaaaacaaactgttcacgtaattgatgtaattgatcgcgaatagccgcagctttttcaaattccaaatcttgcgcaaatttatacatttgttgttccaattttttgatttgttgttgatattctttggcatttttcggtgcattataaagtgcggttggttctgccgccatttttccacgttgtttattggctttcgctttttggtttgcaccttgcccaatatctaataattcaccgactttcttatttaatgcctgtggcacaatgccatgttcttcattgtattttgtttgtttttcacgacgacgattggtttcggtgatggctttttccatggattttgtgatgctatccgcatataaaatcgctttaccatttaagtttcgtgcagcacggccgatggtttgaattaaagaacgttcggagcgtaaaaatccttctttgtcagcatctaaaatcgccacaagagacacttctggaatatctaaaccttcacgcaataagttaattcccactaatacatcaaattcgcctaaacgcaaatcacggataatttcgacgcgttccacggtatcaatatcagaatgtagataacgcacacgaatcccgtgttcatctaaataatccgttaaatcttccgccatttttttagtgagtgtagtgactaaaactcgctcatttttatccgctctttggcgagcttcggaaagtaaatcatccacttgaattgacactggacgaatttcaataagcggatcaagcaaacctgtcgggcgaaccacttgatcgatgatttcactacctgatttctctaattcataggcccctggtgttgcggaaacatagatggtttgcggagctaagcgttcaaattcctcaaagcgtaacggacgattatccaatgcggacggcaaacggaaaccatattcgactaaggtttctttacgtgaacggtcgccacgatacatcccgccaatttgaggcacagttacatgagattcatcaataattaaaatggcatcagggggcatataatcaaataatgttggtggtggttcgccctcatttcttcccgataaatagcgagagtagttttcaattcccgagcaatagcccaattcattcatcatttcaatatcaaattgggttcgttggctgatacgctgttcttctaaaagtttatgttctttaatgaagtattcacggcgtgataccagttcttttttgatgttttctatcgcatctaaaatacgttctcttggcgtcacatagtgagttttaggatagatcgtaaaacgtggtacagcaccaaaactactaccagtgagcggatcaaataaacttaaacgctcgatttcatcatcaaataattcaatacgcaccgcacgatcatcagattccgcagggaaaatatcaataatttctccgcgaacacggaaagttccacgctgaaatgcttgatcatttcgggtatattgtaattccgctaatttcgctaaaatttggcgttgatcgataatggcaccttgttgtaaatgcaacatcatttgtaaatagctatcaggatcgcccaaaccataaattgcagaaacagaagccaccacgatggtatctcgacgttctagaaaagatttcgtcgcagaaagtcgcatttgttcaatttgatcattaatagacgcatctttttcaataaatgtatcactgcttggcacataggcttctggctgataataatcatagtaagacacaaaatattccaccgcattttctggaaaaaaagctttcatttctgcataaagctgggcagcaagggttttattcggtgcaagtaacatcgcagggcgatttaattgagcgattacattggcgatagtaaaggttttccccgagccagttacaccgagcaaagtttggtgagccaaaccatccgttaaattttcagccaatttttcgatagcttgtggctgatcgccagagggacgaaagtcggaatgcagaatgaatggttttgtgttgattttttcagacataaagtgcggtcggttttttgatagttttgaataatgcctattttagcatatttactgtgtaaaattgatcaggcaaaaatctaagttttacacagacttagcgatgtcaagaggaagatgtcacaaattcattaaaaaaactttaaatttttactagacaaaacttaacttattgattttaaattaaaatttaattttaggctaatctataatcaagatcgaataatccttgtaagaacaagggatccgcaaaattttaaaaagttaatccacaaagttatccacaggctctgtggatagaaaaataaatattagggggtatataaaagatgagaaaatttttatttttttatgaaatttttttaaattttgcattgacaagctaactatcgatcattaaaattcgcgccctgttcctcgtgatacaaagtttattcctccttagttcagtcggtagaacggtggactgttaatccatatgtcgctggttcaagtccagcaggaggagccaatttttcttttggtttagagtttgtttgtctccttttacaaattctaaattagcaaccaaaagattttgagcccatccagttgatgggctttatttttaacttcaaaataggattttgcttccgccagttgagatggttgtgccgtataacaaactcagggcaaaaaatagcattattccacctgcgattagtttcacgatgctttcgctttttcctttcgtattttttgaactataccaatgccctaagtggattgcggtatttcgtgcataacgtacaattcctgcgaaggctgacagcataagccctgtgccgaaagacatggctaatacagctaaaattccccagctataaagatcaagcatataagctaaaaataaaacgaaaatcgcaccgctacaagggcgcataccaattgttagaatcacgaggaattgcgattttagattggttgcttgtgcagtttgcgtcgggcttggcaaatgttggtgtccacaactacaggtgtttggctgaaaagtgcggttatttttcaccgcacttttttcgtgtagagggaggggattgagggatttaatggctaatttagcttttttacgataggcacgtagaccttgccaaatccaataacagccgagaaataccaataatagcaaggcagttcgttctaaccaaagctgacttaatttgaaataacgtgatgaaagatttagcactacaacaagcaatgttgttgctgtaatcgcgacaatgccttgcattaaggatgaaagtaagctcaagatagtgctttgttttaattggctttcatgagtggaaagatagctggcaataataaatttgccgtgtcctggcccgagggcatggagtacgccgtaaacaaagctggcgaaaataagtgtggtgcctgccttgatgctattattttgaatttgatgtaaattttccgaaataagctgattaaactctttttgccaactggcaatatgtaagaaaaaccaaggggaaaaatagacaagtaaggcgagtgcaatcactaataacacgagcccagttttatatttttncatttctactcacattgaattattattttttgcgcgaacattacgcctaaggaatcatcttcgttcttttgggatttatcaagtgaagatgcgtaggcttggattttttcatccacattaggttcaattaattttccttggcaatttttcgaaagtgcggaaaaatctaccgcactttttgaagcgtaagtcatcgccacataataagtaggatcgtaagtttgtaagctaaatgtgtttttttctaacttttgcggatgggcgagtggcacatcaaaataatattgcagttgtaagccttgaacattaatgccgtaattttttgggcgaggggaatatttgattttattattctgagcatcatatagatagctgaaataatgttcactgacgatatttcccatcacatcatcaagaagtttttgtttttccgctttagttctagcttgtttcatatcataaataactgcagacgaacttggttcatccaacgtccatttcattgaaaaacctgtgagttgattattttctataatgggcgtggtttgtatatcaataaatgcgtgaggatgggctaaaacaccaaaactaatgaataaaccgagtaataatgaatacgttttcacaaaaaatcctattattttgaacgctagaatttgaagttgtttattctacacgcaaaaacgaatttttctgtcaaaaatgttgatgtaaatcaaaaaaactctcaatagcatttcccttgcctttcaatattcagtaacatagctcccgtcaagtgattgcttgatattcataaagttcctaaataaaataatgataaatatagctaaactactktcctgccacccgtttcgggtggttttttttatctaagtcgaaagatgcactcttgcattgtgcatttattcttattatgatcagctcgagtataactaagagaataatagatgtttaatttaaagcgtgagcattttagagatgattatctttataggttttatcaatatggtgatactcatagtaagattccttctaatttgtataaagtattggcaagaaaattagatatgataagtgcctcagaaaatatcaacgatttacgttctccaccagctaaccatttggagttgcttgagccaaaagaaaataaaatttattccattcgagtgaataaacaatattgtttaatttttaaatatgaaaataacgaagtaaataatttatatttagatccacattcttataatttgtaaggaggataatatgatgacgagaaaacccacctctgttggtgaaattctacaagaagagtttttagaacctttaagtcttaaaattagtgatttagctcaaattttagatgtacatcgtaatacggcaagcaatattgttaataatagttcacgaattacgctagaaatggcagttaaacttgctaaagtatttgatactacgcctgagttttggcttaatctgcaaacacgtattgatttatgggaccttgaacacaataaacgttttcaacaaagtcttgcaaatgttaagcccgctctacatcggcatgatacttctacatttgcaatgtaatttgagccctaaagtgtctatttaatttagggaatacttcactctaaatatttacaagtggttaggtttcgccaaacttttgcaaaatctgtccacttgtttcctatatttcngccctattttccagtagaatagggcgaatttttttgtgaggaattattaatgtcatctcaatttgtgtatacgatgcatcgtgtcggcaaagtagtgccgccgaagcgtcatattttgaaagatatttctttaagctttttccctggtgctaagatcggggttttaggtttaaatggtgcgggtaaatcgactcttttacgcattatggcaggcgtagataaagagtttgaaggggaagctcgtccacaaccgggtattaaaattgggtatcttccgcaagagccaaaactcgagccacaacaaaccgtgcgtgaagcagtggaagaagcggtttctgaagtgaaaaatgcactgactcgtttagatgaagtgtatgcgctttatgcggatcctgatgcagattttgataaattagcggcagaacaagccaatcttgaagccattattcaagcgcatgatggacataatttagataaccaattagagcgtgctgcagatgcgttacgtttacctgattgggatgctaaaattgaacatttatctggtggtgagcgtcgccgtgtggcactttgccgcttattactcgaaaaaccagacatgctcttattagatgagccaactaaccacttagatgcggaatctgtggcatggttagagcgattcttacacgactacgagggtacagtggtagcaatcactcacgaccgttatttcttagataatgtggctggttggatcttagagcttgaccgtggcgagggcattccttgggaaggcaactattcttcttggttagagcaaaaagagaaacgcttagaacaagaacaagcaactgaaaacgcacgtcaaaaatccattgcgaaagagttagaatgggttcgtcaaaatccaaaaggtcgtcaagcgaaaagcaaagcacgtatggctcgttttgatgaattgaactctggcgaatatcaaaaacgaaacgagactaacgaactctttattccacctggcccacgcttaggcgataaagtgattgaagtgcaaaacttaaccaagtcttatggcgaccgtactttaattgatgatttatcattcagtattccaaaaggtgcaatcgttgggattatcggggcaaatggtgcgggtaaatctactttattccgtatgttgtcaggtcaagaacaaccagattcaggttctgtgacaatgggcgaaaccgttgtacttgcttcggtagatcagttccgtgattcaatggatgataagaaaaccgtgtgggaagaagtgtctaatggacaagatattctcactattggtaactttgaaattccaagccgtgcttatgtagggcgtttcaacttcaaaggcgtagatcaacaaaaacgtgtgggcgaattatcaggtggggaacgtggtcgtttacacttagcgaaacttctacaacgtggtggtaacgtgctattactggacgaaccaaccaatgacttagatgttgaaaccttgcgtgccttagaaaatgcgatcttagaattcccaggctgtgcaatggtgatttcgcacgaccgttggtttttagaccgtatcgcaacgcatattttagactacggcgatgaaggtaaagtcacgttctatgaaggtaacttctcagactacgaagagtggaaaaagaaaaccttaggcgatgcagccactcagccacatcgtattaaatataaacgtattgcgaagtaatttagattgagaaagtgcggtgaattttgaccgcacttttcttacttttttgggagtgattatgttagttcatttacatatttttttcgcctttttaagtttggcattgttagtaattcgtggtgcaatgcagcttaatggtaaaaattggcgttcgataaaattattaaaaattttaccgcacttatcagataccttgctgattgtgtctggtgtcgtcattttatacctctttgcttttggtattgaatggtggttagtggctaaattcgcattactgattttgtatattgtgtttgctgcaaaatttttcagtaaaaaagtttctcaacccaaaagcatttncttttggcttgcttgcgtaagttttattggtgcgatgttaattgcctatttaaaataaaacgatgccatctcgccagcttcaaattttaatcagaaaaactttgccgcttgtgcctgatcacgtattaattatcggcgaaagtggcattgcttttnctaaagcaacgaatttgctcgggcaagaatttgaacatattttatttgatggacgaaatggcattcatcttgaagcactggctattgcagctggaacactgaaaatgggcggcacactttgtttagtgttatctgattgggaaaatttatctcagcagcctgatcaagatagtttacgttggaatggaaatcagtcagctatcgccacgcctaattttatttatcatttcaaacagtgcattgaacgttatcatttccccattttaagagaggaaagtgcggttgaatttcctacggttttttattctaacgaacatcacaaaaatgctacgttagcgcaacaacaaattatcgagaatattttacaggccgagcaggatatttattttctaaccgccaagcggggaagaggaaaatccgcattattgggtatgcttgctaaccaaattcaagcaccagtttatctcaccgcaccgaataaaagtgcggtgcattccgttattgaattttcagaaggggacattgaatttattgcgccagatgaattggctttgacgttacaaactgaacccgaatttagtcaatctgcttggttgctggtagatgaagcggcgatgatcccattgccgttattgcaagaatattctcgatattttcaacatattgtctttagtactacaattcatagctacgaaggtacggggcgtggtttcgaattaaaatttaaacggaaaattcaccgcacttttcagcattttgagcttaaacagcctctacgttggcaagaaaatgatccgttagaacattttattgatgatcttttattgctaaatgccgaagatgattttcagcactttgactatagcaatattacttataacatagaggaaaacgctaaaaatctttscttcccctgcttgcgggggaaggtgcccsaagggccgaaggggggatttagatatagctagcctccctcaagctttggaggctctcctcacaagtaaggggagtgaaggaaaatataatcgtcaatttttctttcgagatttttatgggctaatgacgattgccactaccgaacatcgccactcgatcttcgtcgtttactggatgggaaaaatcaacgtttttattttgctgaatatcaacagaatttgctcggtgcaatttgggcattagaagaaggaaatatggctgatgatgagttgattattcaaattcaacaaggcaaacgtcgcccgaaagggaatcttgtgccacaagccttgtgtttccacgaaaatctttcccaagcctgtaaactgcgttcactccgcatttcacgtatcgccgtgcaaccaaattggcagcaaaagggcattgggcaaaatttgatgcaagccatggaaaatgccgatgtggattttcttcagtgagttttggctacaccgacgaactcgcaaaattttggcaaaagtgcggttttgttttggtgcatttaggcgagcatcaagaagcgagtagtggttgttattcagcgattgcccttaaaggtatttccaaagaaggcttggctttagttgatactgcgtacaaacaattccagcgtaatctccctttatcttttcatccgtttgccataaattttgagcaaaatcagcttgattggcagcttgatgattttgattggatgagcttaaaaaacttcgctaattttcaccgcactttattttcgagcattcctgcgatgaggcgtttattaaaattagcaggcaaagaaaatttcccattaatttccgcttatttaacaaaaaaacaatttcctattaacaagaaaaaaggcgtagaatgtttgcgtttagaaattaaacaatatttagagcgaggaactttatgacagaacaagccgcaaaaccaaaaggctggtttaaacgcgcacttgaaaaatatgacaacttcattaaagaatggggtttagatcaaccgaattgtagctgcgtgcctatgtcagcaacagaagatgaaaatggtaatttgaagaaaaaagaatcttctttaaagaaataaatatcaactgtttttttaaacagttaaattattgaaagatagagcaaattccagtacactatgcctcaattttacacaagattgacgcattatttatatttatgaaaacggcttttttccaacctgatattccaacccaacccaatgatcacaaaattttaggcaatgtattaccaggagctgatgcattggcgattagtgaaatttcagagcaaaatcaaaatttaaccgtagtggtaacaccagatacacgaagtgcggtgcgtttatcacgtgttttatcggaattaagcagccaagatgtatgcctttttcctgattgggaaaccttaccttacgatactttttctccccatcaagaaattatttcctctcgtttaagtgcgcttttccatttacaaaatgcgaaaaaaggcattttcttattgccaatttcgacattaatgcaacgcctttgcccgccacaatatttacaacacaatgtgcttctgattaaaaaaggcgatcgtttggtcatcgataaaatgcgcttacaattagaagcagcgggctatcgtgctgtggagcaagtattagaacacggcgagtacgcagttcgtggtgctttgttggatcttttcccaatgggaagtgcggtgccttttcgccttgatttttttgatgatgaaattgattctattcgcacttttgatgtggatacgcaacgcactcttgatgaaattagctcaattaatcttttgccggctcacgaatttccaacggatgataaagggattgaattttttcgtgcgcaatttcgtgaaacttttggggagattcgccgagatcccgaacatatttatcagcaaatcagtaaaggtaccttgatttctggcattgaatattggcagccacttttctttgctgaaatggcgactttgtttgattatttgccggagcaaacgctgtttgtagatatggaaaataatcaaacgcaaggcgagcgtttttatcaagatgcaaaacagcgttatgaacaacgtaaagtggatccgatgcgtccgcttttatcgcctgaaaaattatggctcaatgttgatgaagttaatcgccgattgaaatcttatccgcgcattacatttaaagcggaaaaagtgcggtcatcggtacgccagaaaaatttacctgttgccgctctaccagaagtgactattcaatcccagcaaaaagaaccattgggacaattacgtcaatttattgagcattttaaaggaaatgtactgttttcggtggagacggaaggtcgccgagagactttgcttgatttgctttcaccgttaaaactcaagccaaaacaaattcaatctttagaacagattgaaaatgaaaaatttagcttgttagtcagctctcttgaacaaggttttataattgaacaatcgcttcctgttgcgattattggcgaagctaatttacttggcaagcgcattcaacaacgttctagagacaaacgtaaaacaattaatcctgatacgcttgtacgaaatcttgccgaactgaaaatagggcagccagttgtgcatcttgatcacggtgtggggcgttatggcggtttggtcaccttagatacaggtggcattaaagcagaatatttgctactaaattatgcaaatgaatcaaaactttatgtgccagtgacttcattacatttgattagccgttatgttggtggttctgatgaaagtgcaccattacataaattagggaacgaggcttgggcgaaatcacgccaaaaagcagcggagaaaattcgtgatgtggcggcagagttattagatgtttacgcacaacgtgaagcgaagaaaggctttgcctttaaatatgatcgtgaagaatttcaacaattttccgcaacctttccttttgaagaaacctacgatcaggaaatggcaattaatgcggtaatttcggatatgtgtcagcctaaggcaatggatcgccttgtttgtggtgatgtgggttttggtaaaactgaagtggcaatgcgcgctgcctttttggctgtgatgaatcataagcaagtagcagtgctagtgccaaccacactgttagcccaacagcattatgagaattttaaagatcgttttgcgaatttgcctgtgaatgtcgaagtgttatcgcgtttcaaaactgcaaaagaacaaaaacaaattctggaaaaccttgcagaaggcaaagtcgatatactgattggtacccataaattaattcaatcagatgtaaaatttaacgatcttggattgttgattattgatgaagaacatcgttttggtgtagggcaaaaagagaaaatcaaacagcttcgtgcgaatatcgatattcttacgctaacggcaacgcaawtcctcgaacgcttaatatggcgatgaatggcattcgtgatctttccattatttccacacctcctgctcgccgattaagtattaaaaccttcgtccgtcagaatgacgatcttgttgtacgagaagcgattttgcgtgaaattctccgaggtgggcaggtttattatctccacaatgatgtcgcgagcattgaaaatacagcagaaaaactgaccgcacttgtgccagaagcgcgagtaattgtaggccacggacaaatgcgagaacgtgaattagagcgcgtgatgagtgatttttatcatcagcgttataacgtcttagtttgttcaaccattatcgaaacgggtattgatgtaccaacggcaaataccattattattgaacgagcggatcattttggtttggctcagttgcatcaattacgtggacgagtcgggcgttcacatcatcaggcttatgcttatttgcttacgccaccgccaaagatgatgacaaaagatgctgaacgccgtctagatgcgttggaaaatcttgataatcttggggctggttttatcttggcaacccacgatttagagattcgtggtgctggtgaattacttggaaacgaacaaagtggacaaattgaaagcatcggtttttcactttatatggaattattggatgcagcggttaaagcgttaaaagaagggcgagaaccatcattagaagaattgacgcaacaacaagcggatattgaattgcgtgtgcctgctttactgcctgatgattatctaggcgacgtgaatatgcgtttatccttttataaacgcattgctgcagcagagagtaaagcagaattagatgaattaaaagttgagttgattgacagatttggattattgcctgatgcaacgaaaaatttattacaaattacagagttgcgtttattggttgagccgttgaacgttgtgcgaattgatgctggaacacaaggcggttttattgagttttcagcaaaagcacaagtgaatccagataaatttattcaattaattcaaaaagaacctattgtgtatcgatttgatggcccattcaaatttaagtttatgaaagatctatccgataacaaagtgcggttagaatttgtggtggatttgttaagaacgattgctgcataaaaagaagcccgatcattgtgatcggacttttttcttaaatatatcaagcagattattgcactaataaatagaaattactgtcacctcgtaaaatattaagtgcaactgctgacggttcagtttcaagcactttatttaattcacgaatgttttcgatcatttgacgattaataccaataataatatcgcccgattttaaaccacgttgtgcagctagcgaattaggttgaatttttgtgatttcaattcctttaacgcctttagcatcgtagtctttcaatgttgcgccatctaatgcaggcaactcagtttttgaggaaagttggctactatcatccgcttgtaatttcattttaacgtcgtgggatttgccatcacgtaagtaagtcaagctaatctctttgcctgcaccagtggttgcgatttttgcacgaatttcagcgaaacttgagattttttgaccgttcatcgccgtgataatatcgcccgctttaagtcctgctttttcagcagcagatttcggtaaaacttcacttacaaatgcaccttgttgcgcgcttacattaaaggctttggctaaatcagcattgagttcgccccctttaataccaagcaatccgcgacgcacttgaccaaattctaaaatttgttgcactaaattgcttgcttgattacttggaatcgcaaaggcaattcctgcattgccaccgcttggagaaataattgcggtattaattccaataagttcgccatttagattgactaatgcaccacccgaattacctcggtttactgctgcatcggtttgaatatagttttcataagtgccactgtcagaacctgttgaacgacccaatgcagaaacaatacctgatgtcacagtttgacctaaaccaaatggattaccgattgcaacagtgaaatcgcctacgcgtaatttgtcggaatcagcaaatttgatttctgttaaattacttggtttttcaagctgtactaatgcaatatctgattgttcatccttacccactaattttgctttaaattcacgcccatcttgtaattgcacggtaattttatcagctccatcaataacatgattattggttaaaacatagcctttgcttgcattaataatgacaccagaacctaaaccacggaagttacgctttgattctccacgcccaccaaattgttcggcaaaacgatcgccaaagaagaatttaaattcttcaggaatatcgtctaggaaaggagaacgagaatctactttagcttttccttcaacggaaagagtgacaacggcaggttgtactttttctaacatcggtgcaagactgttttgttctgaaacaaaacttggcaaagtggcttgagcaacatgagcaacaaatgatgtgcntaatacacttaatccaagtgcaatactatttaatacaaaacgtgtttttttcataaatactccaaaataaatttcagataacgtggtctgtaagacaaaaaaataaaaaaaatgttcaataagaggagagcaaattatcttgtttaaaaggaaatcggagcagtacaaaaacggtcttacaagtagcaaattctataaatttatgttctaatacgcgcaattttctagtcaataaaaaggtcaaaaaatgagctggattaaccgaatttttagtaaaagtccttcttcttccactcgaaaagccaatgtgccagaaggcgtatggacaaaatgtactgcttgtgaacaagtactttatagtgaagaactcaaacgtaatctgtatgtttgcccgaaatgtggtcatcatatgcgtattgatgctcgtgagcgtttattaaatttattggacgaagattcaagccaagaaattgcggcagatttagaaccaaaagatattttaaaattcaaagatttaaagaaatataaagatcgtatcaatgcggcgcaaaaagaaacgggcgagaaagatgcgctaattactatgacaggtacactttataatatgccaatcgttgtggctgcatcgaactttgcttttatgggcggttcaatgggttctgtagttggtgcaaaatttgttaaagcggctgaaaaagcgatggaaatgaattgtccatttgtgtgtttctctgcgagtggtggtgctcgtatgcaggaagcattattctctttaatgcaaatggcaaaaactagtgccgtacttgctcaaatgcgtgaaaagggtgtgccatttatttcagtattaacggatccgactttaggcggcgtatcagccagttttgcgatgttaggggatttaaatattgccgagccaaaagccttaattggttttgcagggccacgcgttattgaacaaactgtgcgtgaaaaattgccagaaggtttccaacgtagtgagtttctacttgagaaaggggcaattgatatgatcgtgaaacgttcagaaatgcgtcaaactttagcaagtgtactgagtaaattaacgaatcaaccttctccttttgtagaacctgaactcatttcagaagatgaataatatgcaacttaaagccacttcgccactcgctgagtggctttcttatttagaaaaaagccattttaaacctattgatctcggtttagatcgtattaaatccgtagcggaaaaattggatttacttcatcccgtcccttatgtgataactgtgggggggacgaatggtaaaggcacgacttgtcgcttgttagaaacgattctgcttaatcacggattacgtgtaggcgtgtattcttcaccccatttattgcgttataacgagcgagtacgcattcaaaatcaagatttacccgatgaagcacataccgcctcttttgcttttattgatgaaaacaaaacagaatcgctgacttattttgaatttagcaccctttctgccttgcatttatttaagcaagcaaaattagatgtggtgattttagaagtggggttgggcggtcgtttagatgcgaccaatattgtggatagccatcttgctgtgattactagcatcgatattgatcacaccgattttcttggggataccagagaggccattgcttttgaaaaagcaggaattttccgcgaaaattgccctgtcgtgattggtgaacctaatgtgccacaaacaatgttagatcaggctgaaaaattacattgccaagttgctcgtcgtgatgtggattggttatttgagcaaaatgctgaaaattggcaatggcaaaataaaaaagtgcggttagaaaatttgccgttttgtcagattccattggcgaatgccgcaacggttcttgctgctgttcaatatttaccttttgatatttcagaacagactttgcgaaaatctttgcaagaggtagaactggttggtcgttttcaagctataaaaacagataaacgtgagaaattagcggattatcttggcgtaccagttgaaaccttgccaacaatcatcgttgatgtggggcataatcctcacgctgcaaaatatttatctgaaaaattgaccgcacttaaacgtagcatcgagggcaaaatgattgccgtgtgtgggatgctcaaagacaaagatgcaaatggggtatttgagcatttaacacctattattgatgaatggcattgtgtaactttaggcggttatcgcgggcagtcaggcgatgaattagtagagaaattgaaaagccatttcccaaatattcaagctacatcagataattctgtcatggatggtgtgtgtacagcactcaaaagtgcggtaaaaaatgatgtggttttagtctttggatctttccacaccgttgctgaattttgggctgtggtggaataaaatttatcattaaaacaaagggctgatatttaaaatcagcccttattttttggaatattatctccaagaatatttcacacccacggtgccttggtagcctttatgactatttttttctctgttttatcttttacatcaattgtgagttcaacgacaattaaagtaaaccctttagcataaaacagtattttccttatcggttggattttaaccagtttgtgtttatttaacaagtttagattagtgtgattttagaaaaatcgaagaaatatgatttagaacaatatttataatgtggtgctgtttggcaatggctgaggttcccctaaaaaataaggctcaacacctaatatcaagtcaaaaaccgcttttatgcgggcaaaaacttctcttatttgtgtggaaaaatgtaattctggctgttttgccacaaagcaaatggcatcaatattatgtgcttgggcaattaatagcgcgcgttcgcaatgaaatttttgactgacaatcgtaaatgttttcacttggaaaattttatcggcgcggataacggaatctagggtgcgaaaacctgcaaaatcacggaacattaaagtttttggcacgcccattttgcgtaaatcgcgaaacattgctcttggttcgttatattgcaaagttcggttgtcgccacttaataaaagataattcactttttgttgttcgattaggcttttagctgccattaagcgactatcgtaataaacgttcggttttccgctgacggtgtattttgatgtgccaagcacaagggcgcaggggcgaaaggggagttcatcaatatttgtgaatattttatcgcgaacataaaaactgatgcctcgatccactagcaagcaaagtataatcaatgcaaagattgcgtagagtagtgtgcgaaaaagtgcggtaaattttggggagaatttttttactagcatagtggtaaacataatgaaaaatcgaccgcacttcaaggagaatttgatggattttgtgaatcgcattgatgtgcgataatttagccgtttagacggctaaaatttcttgacaagctaatcgacttactgatagtttaaacgccattctgattattacgataggttttcaatgtctgtgcaaaatgtagtgctttttgacacacagcctttaactctgatgcttggcggcaaactttcccatattaatgtcgcgtatcaaacttatggcacgctcaatgccgaaaaaaataatgcggtattaatttgccacgctttgactggtgatgctgagccttatttcgatgatggtcgagatggctggtggcagaattttatgggagcaggtttagcattggatacggatcgttatttttttattagctcgaacgtattaggtggttgcaagggaacaactgggccttcatcaattaatccgcaaacgggtaaaccttatggcagccaatttcctaatattgttgtgcaagatattgttaaagtacaaaaagccttgcttgatcatcttggtattagccatttaaaagccattattggtggatcttttggcggcatgcaagcgaatcaatgggcgattgattatcctgattttatggataatatcgtgaatctttgctcatccatttattttagtgctgaagccataggttttaatcacgtaatgcgtcaagcggtcattaatgatcccaattttaacggcggcgattattatgagggtacaccgccagatcaagggttatctattgcacgtatgctaggtatgctgacttaccgcaccgatttacaacttgcgaaagcctttgggcgtgccacaaaatcagatggcagcttttggggcgattactttcaagtggaatcctatctttcttaccaaggcaaaaaattcttagaacgttttgatgccaatagttatttgcatttgttacgtgcgttggatatgtatganccaagtttggggtatgacaatgttaaagaggcattatcacgtattaaagcacgctatacgttggtttctgtgacaacggatcaactttttaaacccattgatctttataaaagtaaacagcttttagagcaaagtggagtcgatctacatttttatgaattcccatcagattacggacacgatgcgtttttagtggattatgatcagtttgaaaaacgaattcgagatggtttggcaggtaattaattagtcataaaaangtgcggtgaaatttcaccgcattcttcttttataaccagttattcttcagaactgctttcttccaaagaatcatcttcatctgcatcacaaacacgttctaaacttactacgtgttcatcatcggcagtacgaattaagcgaacaccttgcgtgttacgccctacaatgctcacttcgcttacgcgtgtgcgaacaagggttcctgcatcagtgatcaacataatttggtctgtttcttctacttgagttgcggcaacgactttaccattgcgttcactcactttaatcgaaatcacaccttttgtattacgtgatttagttgggtattcacttaattgtgtgcgttttccgtagccgttttgcgttgcggttaaaattgccccttcaccttttggcacaacgagcgagaccactttatcgatatttaagtctaatgatgcttcagcgttgtcatcagaaatatcttcaatttctaccgcactttcatcgtcagaaatatcgtttgttaaagccagtttgataccgcgaacacctgttgctaaacgccccatcgcacgcacggcattttcagcaaaacgcaccacgcgaccttgtgatgagaacaacataatttcgttgctgccatcagtaatatccacgccgattaattcatcttcgtcacgtaaattcaatgcgatgataccgtttgaacgtggacggctaaattcggttaaggcgattttcttcacaataccgccagcagttgccatgactacgaatttatcttcttcgtaagcagaaactggcaagattgcagtaatacgttcgttttcttgtaacggaagaatattcacaattggacgaccgcgtgcgccacggctcgcttgcggaagttgatatactttcaaccaatataaacgaccacggctagagaagcagaggatggtatcgtgagtatttgctaccagtaatttttcgatgaaatcttcttctttcatcttcgttgcagatttgcctttaccgccacggcgttgtgcttcatagtcagtcagtggttggtatttcacataaccttcgtgagaaagcgtyacaaccacgtcttcttgtgcgattaaatcttctaaatcaatatcgccagaagcagcggtaatttcagttaaacgatcatcaccaaattgtgcttttacttcttccaattcttcacgaattacttccattaaacgttctgcactacttaaaatatgaagaagatccgcaattttaactaataattcttcatattcttttataacttcttcaaacgcaatgcccgttaaacggtgtaagcgaagttctagaattgcgtttacttgcgctggcgataagtaatattgttcgccttgaataccaagattttcttctaactcatcaggacgagcagaagcatcaagaagattaataatatcgctatgtaacgtccaagagcgtgaactgattgatgttgcggcttcttcacggtttttagagttacgaatgatcgcaatcatttcatcgatattagaacgagcaaccgctaaaccttccaaaatatgcgtacgttcacgtgctttgcgaagctcaaagatagaacgacgtgtaaccacttcacggcggtgtaaaacaaaggcttcaataatttctttaagattaaataaacgtggctgaccgtgatccaatgccaccatattgataccaaaggtcacttgcatttgagtgagtgagtaaagatggtttaataccacttcccccactgcatcacgtttaatatcaatttcaatacggatcccttctttatttgaaaggtcagtaatattgctgataccttcgatttttttctcgcgaattaattcggcgattttctcgactaattttgctttatttacttggtatggcaattcagacacgataatttgctcgcgtcctttttcgttggtttctaccgttgcacgagcacgaacatacactttaccacgaccagtgcgataggcctcttcaatccctttacgaccattaattaacgcagccgttgggaagtcaggccctggaatatgttgcattaattcatcaatggtaatttcatttttgtcaatataagccaaacaaccatttaatacttcgtttaagttgtgagggggaatgttagttgccatccccaccgcaataccagaagaaccatttgctaacagtgctggaatacgagtcggcaatacatctggaatcattaattcgccatcatagtttggcgagaaattgacggtttctttatccaaatccgtgagcaatgcttgcgtaattttttgcatacgtacttcggtataacgcattgcagctggcgcatcaccatcaattgaaccaaagttaccttgcccatcaaccaacatatagcgaagtgagaagggttgtgccatacgaacgatggtatcgtacacggcggagtcaccatgcgggtgatatttaccgattacatcacccacaacacgcgctgattttacgtattttttattggcggtattgccttcgcgatccattgagaatagtacgcggcggtgaacaggttttaaaccatctcgaacgtcaggtaatgcacgcccaacgataaccgacatcgcgtagtcaaggtaggaagatttaagttcttcttcgatattgacaggggtgatagatgattggattgaatccgtcattggtattccttttttgatcaaaaattgtggcggattatagcataaaattgtggatatgtggtttttgatatcaggatttcgcctgatggcgccttactttttctttgcttcgccaaagaaaaagtaagtaaaaagaaaggcgaccctacttttccttgtttcctttgttccattgaatttccttaacggaaattgccggacctggctacgctcaaacagacgaaaatttcctacaaatncaattccacaaaggtggaaaagaagggaacccaattnntcctttatccgatttaaagtgcggtcaaaactcaaaatatttttggtccttaaaatgaatttaaaattaaccgcactttttaaataatgctctgataaattcggggccccatataaatcgcctttgcgactttcaatttttaggcaatttgcgtctgtttgagcgtagcgagttcagcaaatttccgttaagaaaattgaaacaaagcaaagaacagcgatttaactggggcgtgttttctttgcctactttcttttacacgagtaaaagaaagtaggtcgtcgtcaggcgaaatcctgacctaattatttccaattttcttttttggctttctgcaacttcccataagcccccaacaacgcctgatgttccttaaagtttttcaaattttcatcacttgcaggaagattgtagaacggattgccaccttcagagacagcagcccaagcttgtttaactgcatctttaccatacattttctcaaatactgcacgatattgtgctgggtcgcgattttgatctaaatgtaattcaatgatggaaattaatgtgcggtaataattcacaggttctgtagtgaatacggagctgttcatattcagcgtccagtttgcccaatctaatgcctgttctaattcgcctaatgcaaggtggagcatagattttaattcacccacgcgtaaggttgtccagccgctatttttaggtgcaacgatgccgataaattcacgcacgcgagtcgcatcgtcaatatcttgcccatctaattcttctaataattcttgataggtttctgcatcgtgatgccagtttggtaaatccagtaaaatttcgcgccaatccattcccatattgttgttggcataaattaaatcgtctgcaggataaatatcagacatgcctggcacaataatacggcacgcatagacatccaaatggttgtaatccattacgtaaacttctttttcatccgcacggaaaattgccattaaattattgtattcttcctgtgttgtaccactgaaatcccaatcagcaaattcataatcaggcgtttctttgagtaaatcccaagaaattaaaccgcttgagtcaataaagtgggtttctaaattagcgtgttcagccacatcatcgttattgaaagagggcggagagaaaacatccaaatctttcaagctacgaccctgtaaaagttcagtcacagtacgttctaatgccacttggaaatttggatgcgcaccaaaagaggaaaagcacgtgccgttattcggattgagtagcacaacgcaaataacaggatattttccgccaagtgaagcatcaaatgcataaattgggaaaccttcttcctctaattttgcaatagaagcctgaatagatggatagcgatccatcacagattttggaatttctggcagactaattgcttcagcgataattttgtttttcacataacgctcaaaaacttctgacaagccttgcacgcgtgcttcaaattttgtattgcctgcagacatgccatttgaaacataaaggttagcaataatactttgtggaatgtaaacggtttgttcgtccgattgacgaacataaggcatcgccacgatcccacgatcataattgccagactgtaaatcgactaataattcaggcgtaagctcggcattaggatnaaaataatccaataaataatcatctnaaatgccattaggcagtaaagcatcatcttcaatcgggaaccatttttcattgggataatgcacaaaatcgctgtttgcaatttcttgtcctaaatagaaatcggcaaagaaataattagtggaaagacgctcaaaatattcaccaagggcagaggctaacgccgcttttttacttgcccctttaccattagaaaaacactgcggacagtctttatcgcgaatatgcacagaccacacatttggcacaggattcaaccaagatgcctcttcaatattaaaaccaagtgcggtcaatttttgctgaaattttgcaatactatcttctaatgcggcatctttgccgagaataaaggtttgttctgtcatttttgttcctaaatgagaaaaaagtgcggtgaataataggggagttttaatagcggagcaagattttttcggcaaaaataaaccccgaaaaacttcggggttttctaccgcacttttaacgtatatttgattggcgttaaagtaaagttggattgamccgcacttttaaggcaattgtaattgcggcgaaaattttttcatcgttgagaggaaagttttcgcgtaaagtgcggtgggaatcagttatgtttatttgagcttgtgataattcatttaataaaatcgggagagaaagattgagctgctcggcgatttgttgaatagaaaaatgctcgaaagtcatcatcaagcgatctaaattgcagtaagaaggcatacgattatgcgtgatgagatcggcaaattgagtgttgatttttatccatttcttcttacggctataaaaatgcagtaacaaaccaaatacggtaaatccagcaaagattaggtaaattgcttggtaacgaaaaacaagctgaagcacaagctaaatatgcggaagacacgctgaaacaagcacgcgattttgctaaacaacatcataaaacagcctatttagcgcgtaatgcggatggcttacaaactggtcaaaaaggttcgattcatacggaagcaatggaattggttggcttggaaaacgtcgcagagggagaacaaaaaggcttaactcaagtttcaatggaacagcttttattgtgaaatcctcaaatgattttcacccaatatgatgagttttataaagtgcttgaaaacaatccgcagtggaaagaattaagtgcggtgaaaaatcagcaagttttctttgtgccgcatacaccatttggttggattgattcgccaccgagtttaaaccgtttattaggcgtgcgttggttacacatatgttgaatggtaaggcgaatgctgactttgtgcctgaaatgcaacgtttctataaattgttctatcacattgatttaaccaatgaacaagcacttaagttgtttcaagtaaaatgatgagatcgacttttcttttacgttcgcctcgtttgttttttgtcttgttagttggattgttacttggcagtattttacttgctttgaatgtggggaaatacccgctttcgcctagccaactttgggagacaataagctgttcgtttagcgggcaatgtgaaggaaatacggaacaaacagtactgtagcaaattcgtttgccacgtatttttgccgcttgttttgtcggggcggcgcttgcttgtgggggcgcaacttatcaaggtatgtttaaaaatccgcttgtttcgccagatattttgggtgtttcagcgggggcaggttttggggcaagtttggcaattttttataatttgccaatgatttatatccaattttttgcttttagcggtggcattttagctgtgttatgtgtatcgctcattgcctcgcgtagtcgtacacaagatcctattttagtgctggtgctttctgggattgcaattggttctttacttggtgcaggcatttctttgttaaaaattcttgcggatcctttcactcaattaccttcaatcactttttggctacttggtagcctgacggctattaatcaacaagatttaattcaattgatcccgatgttgttgctagggattgttcccatttttttattacttactgatacgctggctcgcacgattgcaccgattgaactgccactcggtattctgacttctgcttgtggttattagtgcgagggcaaaaataatgttactcgaaacccaaaatcttgccattggctatgaaggaaaaacactggttcaacatatccaatttaccctagaggaaaatcaaatttgttgtttgcttggtgcaaatggtgcaggcaaaagtacgtttttgaaaactttacttggtttacaaccgcctattggtggtgatattgtttggcaaggaaagtcgctttctgattattcaccaacagaattggctcggcatattgcttatgtgccacaagcgcattctcatttatttccttttttagtgcaggatatggtgatgatggggcgatctgcttttttgaagtggtatcaaactccgaaaaaatctgatttggatttagcattaatggcattgcaagagttagaaattgctcatcttgcgcaacgttattatcatcaattaagtggcggcgaaaaacagcttgtgttgattgcccgtgcgattgctcaacaagccaaacttttaattatggacgaaccgacttctagccttgattttggtaatcaaattcgagtgttagaaaaaataaaacaactgcaaaagcaaaatattgcgcttattattagtacgcataatccacaacaagcggcatttttaggggataatattgttttgcttgatcaacaatttggctttcaacaaggcgataaaaaacatttattaaccttagaaaacttggcgaaaatttaccgcacttcgcccgaacttttacatcaacatttgaataaccacattgaaaaatcactatgactatttacgacatcaattttgctgaactttatcaacaacacttaatcgcttgtaatcattacaacttacctccgataaaatgggataaaaaagctgtgaaaatggcagagaatttagtcggaaaaccttctgcatataatcagcaattattgcaagctatgaatgtgcaaaccgatgaagctgtgttggatattggctgtgggcctggtacttttgctgtgccgctcgcacaacaaggctcaacggtatatgctttggattatagcaatggaatgttagactgtttggcacaatttaagcagaaatttggtttgcatcatctcacgacatttcataaatcttgggcggataattgggatgatgtgccacaagctgatgtagtgttggcatctcgttcaacgttggtggacgatttggacgatatgattgaaaaactctgtgccaaagcgaaaaaacgtgtgtttttgacttctgtcacacaacgccatttcttagatgagggcgtatttgaggcaattggccgtgaagatattggtttccccacttatatttatttactcaatcggttgtatcaaaaaggcattcaggcaaatttgaattttattgaaacggaatcgggttgttttcaaggtgaaagctacgaggatttattagcctcggtggagttttctttaggcgagctttccgaaaaagaaaaacaaggtttgaaagccttttacgatcgtaaacaagccaataacgaacccatttctcacggacagaaaaaatgggcgttaatttggtggaatgtggatcgcatctaatgtttcaagtggaatcaatttatttttctatcactaattaaaaggacgattatgttatttgctttacctgcgctgaatgataactacatttggctttatcaacgagaaaatctgccgcttattattgtggatttgcctgaaacggacaagctgtttgcatggctagagaagcaaaacgcaacgattgaagcggtgttgcttactcacgaacatgatgatcatacacaaggtgtgtcggcatttaaaaaacgttatccaacagtgccgatttatgggccgcaagaatgtgagaaaaaaggtgcgactcaaattgtgaacgaagggaagawccttaccgcaaattatcaaattgatgtcattccgacggggggacacactaaacagcacgttagttttttagtggataatcatttattttgtggtgatgcgttattttctgctggttgcggacgtgttttcacaggtaattatgcgctgatgtttgaaggtttacagcgtttgaatacattgcctgacgagacgattgtttgcccagctcatgaatataccttggggaatttagcatttgcggaaactgtgctggtggataaaagtgcggtagaaaaaagtgcggtagaaaaacaacgtatttttgttgaaacacaacgggctgaaaataaaccgagtttgccaacaaccttaaaactagagcgagaaattaatccgtttttacaagcaaaaacacttgaagaatttaccgcacttcgtaaagccaaagatattttctaagttatctttttattgggggggagcacaaagtgcggtgattttttaaattagcagattatttctttctcgctaacatggtggcaaatttcattttaatgcgattgccgttttcatcggttttgtgtaattcgcccatattttcgttatattctaagaattcccaatctttgtaatattctttcaattcgttttcagcaaaagtgaaagagaatggaagtgggcaaggcacatcatctgtggacatggcggcaacgattaagttatacccgccaacattggtatgttctttcatatttttaatgattgatggcacacgttcacgatttaagaacataaataccaccgttgaaacaataaaatcatagttttcttgaatgttggcggcgttaatgtcgtaaagtgcggtagaaatattaagattttctttctctttagtttcatttaaaaaggcaatgctgttttcattgtgatcccaagaggtcacatcatagcctaataaacttaaataaagtgaattacgcccttgtccgcaacctaaatctaatactttacaaggcgagataatttttgcagcatccaccacatcgccgtgaatggcagtcgtgttgtattttttactgaaataatcttcttttttgcaatagaaacctagggtacattctaggtcatcagaaagtgcttctacacgatgccatgcttgaggttcaacaaaaggaatgtggctttctggggtaaaaatatgctcggcaataacatcgccattttcggttagctcataaaatttaagcttaccttttaatacagttaattttccccaagtgccgacttttgtattgtgcttttcttggaacatttgtggcaagttgtcttttgtccacactggcatttgtttatagcaaattaattcgtttttcatagtattctccaaatagataaatagttgagtgttatggtaggttataagtcatctattttcaacaagaaaataaaaaggcaacgtaatgttgccctcatttagattgaattgattattttacttgcatgcccgcagtgacaccgctatcagcagaaagtaagaataagtcactaccgcctgttcctgcggatagaatcattccctcagacacgccgaatttcattttacgtggtgcaaggtttgccaccataatcacaaaacgaccttctaattcttcaggtttattgtaagccgctttaatgccagagaagacttggcgagtatgatcaccaagatctaattcaaaacgtaaaagtttattggattctggcaccgcttcgcatttcaatacttttgctacacgcatatcaagtttagcgaaatcatcaatcgtgatggtttcagcaataggttcaacggcagaaagtgcggttggttttgcttcagttttttctgcggctttattggctgctgcaaataaggctttagtttcttccacaacggcatcaatttgttttttctctaaacgagagaataaggctttaaacggtgcaagggtatgaccaagtaatggttgatgaatattatcccaacgtaattcagcttgtaagaaggtttctgcacgttctgctagttttggaagaacaggttttaagtaagacatcaatacgcggaaaagctcaatacccattgaacatacggcttgcaattctgcctctttgccttcttcttttgcaatcacccaaggggctttttcatcaatgtatttattggctttatctgttaatgccataatctcacgaatggttttattgtattcacggctttcgtaataagcagcgatttgctcggcttgggcggtaaattctgcaaataatgatttgtcttccagtttatccgcaagtttgccttcaaagcgtttcgcaataaagcccgcattgcgtgaagctaaattcactaatttgtttacaatatccgtattgacacgttgtacgaaatcttcaaggttaaagtctaaatcttcaatgcgatcatttaattttgctgcatagtaataacgcaaacattcaggatcgatatgattcaaataagtgctggcttgaatgaatgtnccgcgagattttgacatcttcgccccatccacagtgacatagccatgagcgaacacattagtcggtttacggtagccactgccttcaagcattgcaggccagaataggctgtggaaataaacgatgtctttaccgatgaaatgataaagctctgcatcactgccttcagcccaaaattcattgaaatcaatgccttcacgattgcatagatttttgaatgaagccatgtagccgattggcgcatctaaccaaacatagaagaatttatcttttgcgccgggaatttcaaaaccgaaataaggtgcatcacgtgaaatatcccattgttgtaaatcgctctcaaaccattcttgcattttgttggcaatttcagattgaagtgagccagaacgagtccattcttttaacatcccttcaaatgcaggcaagtcaaagnaaaagtgttcagattcttttacgataggtgttgtgccagaaacagctgaacgaggattaattaaatccattgggctataagtagaagcacacacttcgcagttatcgccatattgatcttctgctttgcatttcgggcaagtgcctttcacaaaacgatcaggcaagaacatatttttttcagggtcgaataactgagaaataactttactcttaataaaaccattggctttgagtttattgtaaatttctgcggtgagctgtttgttttcttcgctgtgagtggaatgatagttatcaaaactaatattaaaacctgcaaaatcacgaatgtgatcggcttttgctttggcaattaattcttcaggtgtaatgccaagtttatcagcattcaacataatcggcgtgccgtgcgcatcgtccgcacagacaaaatggattttattgccacgcatacgttgaaaacgcacccaaatatccgcttggatatgttctaacatatggcctaaatgaattgccccattggcataaggcaaggcgcaagtgactaaaattttacggggttgagttgtcatttattattctcttttttagcatacaaaaattgtgcttatcttactttaaataggggattttttctagtttgaaaaactttaacttaacataccgcactttccgtgattaaatatgcccgacaaatttactctactaaacaggaagttattatggcaacctacttttctgataatttgactgccgaccagcaaaaccaagttcagcagattattcaacaatttcagcatccaaccctgcaaaaggatctgattgtgcttaatactttgaaaaaagtggaaaagggcggcgatactttacgcattgaattgcaattaccttttgcatggaattctggtgcagaacagttaaaacaagcggtttcagatgcgttgttgaaagcaacagattgtaaattaattaaatgggcggtggcttatcaaatcgccacacttaaacgtgcaaacaatcaaccggcagtaaaaggtgtgaaaaacattattgctgtgagttctggtaaaggcggcgtagggaaatcatcggtttctgttaatctagctttagcattacaagcacaaggcgcacgtgttggaattttagatgcggatatttatggcccttctattcctcatatgttaggcgcagcggatcaacgcccgacttcgccagataatcaacacatcaccccaattaaagcacatggtttatctgcaaattccattggctttttaatgaatgaagatagcgcaacaatttggcgtggcccaatggcgagcagtgcattaagccaattattaaatgaaaccctatgggatagtttagattatcttgttatcgatatgcctccgggcactggcgatattcaacttaccttatcacaacaaatccctgtgactggtgcagtggttgtgacaactccacaagatattgctttgcttgacgcagtgaaaggtatttcaatgtttgagcgagtatccgtaccagtgttaggcattgtggaaaatatgtcgatgcatatttgtagcgagtgcggtcatcacgaagcgatttttggcacaggcggtgcagagaaaatggcggaaaaatacaatgtgaaagtattagctcaacttcctctgcatattcgtatccgtgaagatttagatgcaggcaacccgaccgttgtgcgagtgcctgaaaatgaaatttcacaagcgttcttacaacttgccgaaaaagtctctacagaactttactggcaaggttccgtaatcccaagcgagattttatttaaagaagtgaaataatcaaaaaagatagggctgcatgtgcagcccttttttaatgggatttttaccccacccatttcaccacttcatccaatcctttacgggattttttcgcaatatcgcgtgagcgatagccaaaggttgcggcgacagaaaccgcatattcttgaggatcgaataatccttcttcggcgaggcattcattcattttgtcgtaatgaaaaccttcaattgggcaagagtcgatgccaagggctgaagctccagtaagcatatttgcaagggcgatataagtttgtttgctgcaccaatcaaataaagtgcggtcgttttcgagtaatttcatatcttcttcttgcagggctttgtattttgtgagggcggcttgttgttgctctgcgttcaagcctttgcgtgccatcacatccacaaaaaacggactatcataacgggcatttttcttcgcgagaattaccacaagatgactgcaattatcaagctgatttatcattccccagctaaaaggtttcattttttcgcgtaaggttttattttgaatcactaaaaatttccaaggctcagagcctacagaactcggcgataatcgaccgcactctaaaatacattcaaaatcttcatcactgattttttttgttgggtcgtaataacgtgttgagctgcgttgatggaagagttcaagaacttgttcacgagtaagttgagtcattttatttcctctttgttaaacaaaaatgtggtgccatattaaagattagtttttgctaaaacaagggaaagattctagaatagtcagcgcttttatcacagagggtgaaaataataatgacaagaattgcaattattcctgcgagagcgggttctaaaggcattaaagataaaaatttacagcttgtggggggcgtttctttggtggggcgagcgattttggcagcgcaagaatcgggtatgtttgatcaaattgtggtgacatcagatggcgaaaatattttaaaagaagccacaaaatacggcgcaaaaccagtggcacgccctgaaagtttggcacaaagtgatacacgcaccattgatgctattttgcattgcttagaaacacttaatatttcacaaggcaccgccgcacttttgcaaccaaccagcccattgcgtaatgctttagatattcgtaatgcaatggaaattttccttggcggcaaatataaatccgtggtttcagcttgcgaatgtgagcatcatccttataaatcctttactttagaaggcactgaagttcagcctattcacgaattaacggattttgaatcccctcgtcaaaaattaccgaaatcttatcgtgcaaatggtgcaatttatattaatgacatccaaagtctctttgaagaaaaacgtttttttattgcgccaatgcgtttttatttaatgccaacttatcgttccattgatattgactccacacttgatttgcaattagccgaaagtttaatttcaaaagaattctaaaaaaattggccgcacttttgatctgcactccaaaagttggattaaacaaccaactaaggtgcagattttttatgaccaaatacaatttttttcaagcaacaagtcatcgagttttatcttcaaaatagtaaaaattgttgattcctctgcaggcattttcaacttgccagcagaacattgtgacattggattaatcaatttgatcatattagaatcaatggcttagcgttgctgggtaagaagtgaaattactcatctgaatttaaacttaggatgatacaatcggttaaaagtaagcaattttctgcagaacccgcttgcttacattttggcactggaaatggctagggattaagaataccgagttcaagtgtgtgaaaggcaagctctatttatccccaattaaggatttatttaacaatgaaattattgcttatgatttagtgcgaagcccgaattctgagcaaattacccaaatgatgaaacaagctgtagcaaggcttgcaggcgcaaaaccgattttacattccgaccaaggttggcagtatcagatgataggttatcaaaacatacttagggagaatggcatttaacaaagtatgtcaaggaagggaaatgatttagataacagtgcgatggaaagcttctttggatgattaaaaacggaatgttattacggcaaacgatttgagatgttcaaacaactggaaaaaacaattcatgagtacattcattattacaaccatgagcacattcaggggaaaccaaaatggctgagtcctgtgaatgacatagctcaacccttgaactaaataagtctaattttttagaaggtcaattccagtaaaatcaaggctttgtaatgtcttatagtgatgtatgattttggtttttggtggagctggggggagttgaacccccgtccgaaattactctaccttcagtactacacgtttagtctcgtctttaatttcacttaagcatgcggacagacacgctaaacttaagctagtttgattcaatttagtgcttcgatcctcaaacggtggcttccacacgatctcgttttggtttgactccgcgttatccccgtcttacgagcggaagctggagcgcgaaggctaaatgcaggttattaagctgctaaagcgtattgttcgtcgtttgcgactatttttttgcggtttatttacgaggcctaccgcacctcgacgtgcaccttgggcttcgctaatcccgtcgaatccagaatcagccccaaaattgcgtgttagtctagcaaaaaaagaaaggtagggaaagtcgagattgattgaatttttgtatgaaagctagaataaccttaaatattgtctatttattattggcttattaccttattaacaattcatctctaaattgattggagacgatcattgattttttatggacgggaggcttgataatggcgttaattaattggcattatttcacgctttatttttgatgataggagctatagatttgtaaattatggcaaaattaaatatatttacgaattcctgaaaatataacacagcatatatgctataattagctcctaaactttttggaaaatgttatcttattctagtatttatcatcaatgattttataaaatttcttgcatattaaatttttatcactataatgtggcacatatttcggacgcggggtggagcagcttggtagctcgtcgggctcataacccgaaggtcgttggttcaaatccagcccccgcaaccaataataagttcagtaaaagaaccccagttttggggtttttttctataagaaatttagtaactgggcttaggttcttatgaacctaaccctttttttatgcctgagatttaataaactatctttttactattactaaaatagagggataagtattgtttaggataaggtttcataaggttatgatatagtgcggtgaattacaccctatataggagtagaaattggctacattagaacaaaatttacaagaaatgctacaagatgcggtagaggatttaggctgtgaattgtggggaattgagtgccagcgcgtgggtcgttttatgacagttcgtttatttatagataaagatggtggtgtgacagttgatgattgtgctgatgtaagtcgtcaagtgagtgcaattttagacgtggaagatccaattgcggataaatataatctagaagtgtcgtcacctggtttagatcgtccgctatttaccttgccgcaatttgaacgctatattgggcaagatatcgcagtgcatttgcgaattccagtgatggaacgccgtaaatggcaaggtaagttagagcgtattgaaaaggatatgattactttaattgttgatgatcaagaacaaattttagtcttcggaaacattcaaaaagcgaatgttgttgcaaaattttaaaaggagaaaaagagaaatgagtaaagaaattttactggcggcggaagctgtatccaatgaaaaattattaccacgtgagaaaatttttgaagcattagagagtgcgattgcgatttctactaagaagaagtttgaatatgaaacggatattcgcgtttcaattaatcccaaaacaggagaatttgatacttttcgccgttggttagtcgtagatgaagtaaaagtaccaacgaaggaaattactttggaagcggcgcaatttgatgatccaaatttgcaacttggagagtatgtagaagatcaaattgaatctattgcatttgaccgtattgcaatgcaaacggcacgtcaagttattagcactaaaattcgtgaagccgaacgtgcaaaagtggttgaacaatttcgtgaagaagaaggaaaaattgtaacaggcactgtaaaaaaagtaagtcgagacagtattattttagatcttggcaataaagcggaagcgatgattgcgcgtgaagatatgttaccacgtgaaaacttccgtccgggagatcgtgttcgtggggtactttataaagtaaatcctgaaggcaaaactgcacaattatttgtgacacgttctaaaccagaaatgttgatcgaattattccgtattgaagtgcctgaaattggcgaagaaatgattgaaattcgtggtgcagctcgtgatgctggctctcgcgctaaaattgcagtgaaatcaaatgataagcgaattgatcctgttggtgcttgtgtaggaatgcgtggtgcgcgtgttcaggtaattacgaatgaacttggtggcgagcgtgtagatatcgtgctttgggatgacaatcccgcgcaatttgtgattaatgcgatggcaccagcggatgtttcttctattatcgttgatgaagataatcattctatggatattgctgttgaagctgataatcttgctcaagccattggtcgtaatggtcaaaacgtgcgtttagcaacacaattaacgggttggacactaaacgtaatgacgactgatgagttaaatgctaagcatcaagcagaagataacaaagtgttaaatttatttattaacgcattagaacttgatgaagaatttgctcaaatccttgtggaagaaggcttcacaagtttagaagaaattgcttatgtgccaatgaatgaattgacagcaattgatggtttggaagatgaagatcttgttgaagagcttcaaactcgtgctaaaaatgcgattacagccgcagcagtagctgaagaagaagcactgaaaaaagcgaatgttgaagatcgtttattgaatttagagggaatgaatcgtcacgttgcaatcaaactagcagaaaaacaaattaccacccttgaagaactcgcagaacaaggcgttgatgatttaactgatattgaagaattaaccgcagaacaggccgcagatttaattatggctgcacgtaatatttgttggtttggcgaagaataaggagagcagtaatgactgaagatgttaaggctgatgcgccaaaaaaattaagcattcagcgcagaacaaaaacaacagtgagcagcaccacaactggcggtaaaagcaaagaagtacaagtagaagtacgtaaaaaacgcacagtaaaaactgatattgctcaacaagaagaagcaaaattaaaagcacagcaagaagcggaagcgaaaaaaattgctgaacaaaaagcagcagaagaaaaagctcgtttagaagctgaaaaagcaaaagctgaaactgctaagccagtaaaaagtgcggtagattctaaagctaaatctgttgagtctgaaaaagagaaacgtaaagcaggagaagcagaacttcgtcgtaaagctgaagaattagctcgtcaaaaagcagaagaacaagctcgtcgtgcagtagragaagcgaaacgttatgctgaagcagatgattcagacaatgaatcttcttcagaagactattctgattacaatctaagttcaagatatgcacttgaagcagaagatgaagaagatcgtcgtaatgaaaatcgtggtcgtggcaaaaataaagtagcgaaagcgaaaaaaggcggtcgcgacgatgaaaatagcaaaaactcgaaaaacgagcgcgaatctaatcgtaaaaatcaaaaagacgctaagtttggtaaaggtaaaaatggcaaaaaaggtgccgcacttcaacaagcctttactaaacctgctcaagtagttaaatcggatgtagtcattggagaaaccattacggttgcagaacttgcgaataagatggcggtaaaagctacagagatcatcaaaatgatgatgaagatgggcgaaatggttactatcaaccaagttatcgaccaagaaaccgctcaattagtagcagaagaacttggtcataaagtgattcttcgtaatgaaaatgagcttgaagaagcggtattaggcgatcgtgatgtaaacgcagaaaaagtaacccgtgcgccagttgtaaccatcatgggtcacgttgatcatggtaaaacctctttacttgactatattcgtaaagcgaaagttgctgcaggcgaagcgggtggtattactcaacatatcggtgcgtatcacgtagaaatggatgatggcaaaatgatcaccttcttggatactccaggacacgcagcgtttacttctatgcgtgcacgtggtgcaaaagcaacagatatcgttgttcttgttgttgcggccgatgatggtgtgatgcctcaaactatcgaagcgattcaacacgcaaaagcagcgggtgcacctttagtggttgcagtaaataaaatcgataaaccagaagcaaatctagatcgtgttgagcaagaattattacaacatgatgtcatttctgagaaattcggtggtgatgtgcaattcgttccagtatcggcgaagaaaggtacaggggttgatgatttattagatgcaatcttacttcaatctgaagtgcttgaattgaccgctgtaaaagacggcatggcaagtggtgtagtcattgaatcttacttggataaaggtcgtggccctgtggcaactatcttggttcaatcaggtacactacgtaaaggtgacatcgtactttgtggttttgaatatggccgtgtgcgcgcaatgcgtgatgaaaacgggaaagaagtggatgaagcaggtccttcaattccagttgaattattaggtctttcaggcgtgcctgcagcgggtgatgaagcaactgttgtgcgtgatgagaaaaaagcacgtgaagtggcgttatatcgtcaaggtaaattccgtgaagtgaaattagctcgtcagcaaaaagcgaaacttgaaaatatgtttagcaatatgtctgaaggcgatgtggctgaattgaacgttattgtgaaagcggatgtacaaggctctgtagaggcgattgttcaagcgttaaatgaactttctaccaatgaagtaaaagttaaagttgttggttcaggtgtaggtggtattactgaaactgatgcaactttagctaccgcatctaatgccatcattgttggctttaatgttcgagcggatgcaacagctcgtcgtgtcattgaagctgaaaacattgatttacgctactactcaattatttatgaattgttgaatgaaattaaagcagcaatgagcggtatgttagagcctgaatttaaacaagaaattattggcttagctgaagttcgtgatgtattccgtcatccgaaatttggtgcaatcgcaggctgtatggtaactgagggtgtagtgaaacgtaacaacccaatccgtgtattacgtgacaacgtcgttatatttgaaggggaattagaatctcttcgccgtttcaaagacgacgtatctgaagttcgtaacggtatggaatgtggtatcggcgtgaaaaactacaatgatgtaaaagtcggcgaccaaattgaggtatttgaagtggttgaagttaaacgttcaatctaacttttaacaaaataaagggcggttaaaaatcatagtgtttttaatcgcccttttgttattaaataaaccgcatcaaaattataaaccagttaaatcctcagcaatttcttcagcttgtttaatcacataagttaccgcttcttcctgtttatcaggcgggtatttatatttttgtaaggcacgtcgaacgagtaatctaattcttgcccgcaccgcttctttgtactgccagtcgattgtgaccgattttctaagtgtttccgtgatttctttcgccagtttagaaagcacttcatcacccatcaaatcttttgcactttgattttgagatagagcttcatagaaggctagttcttccttggttaatcctagttttttccctaatgctaaacgttcttggaaatcttggctcattttaaagagttcgtccaaaatctctaccacagtcaaattgtgattgtggtattgattcaatgcttccttcaaacgccgttcaaaatctttttgcaaggttaagtttgtgcctgatttaactttaatttcacttgccaaataacgctccatcgcgctaacccataaatttttagttgggctattttttacagtttgtaaaaattcctcggaaagcaaactgatttgtggttgtggtttttctagcagatcgaataaatcaatcacgccttcagaatacacagtttgattgaccaattttttcaataaaatctgtctttcatttgtgcctgtgcctttttgttcacgtttagttaaaattgcccgtacggcatcataaaaggcgatttcttggttatacggctcaacttcagccaatgtgccgcacagcatatagcctttttttaccaagcctgccgttttcaaaaaggcttttttgcgtggctcggtttcttttttattaaaccaatgctgctcgtgcgctttgccatcaaacgataattgatcaaggcttaaaatatggttggcggcaaaacgaatcgccatcaaaagatcattcggattatctttttctaaggcagcctgaacatcaaaagtttttccttcaattggtgtcgcaaacaaagttcggataaattcaagctgttctttcattttaaagaacacgctttgcacatcttccgctaattgacctttgcctgtagagttggtgtattgctgtgtggctgctcgtaattcttttgccaaaccaacataatctacgataagcccaccgttttcacgacttttgttagcgaatacacggtttactcgtgcgatggcttgcattaggttatgccctttcattggcttatcaagatacatagtgttacagcacggtgcatcaaagcctgtcagccacatatcacgcacaatcaccactttcagcggatcgttcgggtctttaaagcgacgttctaacgtttgcttttcctgcttactgtaaatatgcttttgcatttcaggcgtatcgcttgccgaacctgtcatcacaattttaatcgccccttcgttaatattgtccgaatgccattcagggtgcagagcgatgatctgattatacaaatccacgcaaatttgacggctggaaaccaccatcatcgctttgctgtccaccacttcattgcgtttggcaaaatgttgcacaaaatctgcggccaattcgataagacgctcttgtgagcctagtaatttttcccgcaaacgcagggaagttgatggctcctcttctagtagagcatcaatttctgcaaacaaagcatcgtggtcttttttatttaagcgaatttggcgagcatcatcataaacaatcggtacagtcgctccatcttccaccgcatcttgcaagtcataaatggacacataacgaccgaacacatcttgcgtgtccttatcttcaaggctaattggcgtacctgtaaaaccaataaacgaggcattaggtaaagcatcacgcaaatggcgagcataacctgtctgaaacttgccgttatgcagcttttgcgtaaagccatattggctgcggtgagcctcatcgctgatcacaataatattgttgcgctcatttaaaatagggaagcggctttcttcctcatttagggcgaatttctgaatcgtagtaaaaaacacgccgccgacttcattttgtgcgagcagttggcgcagttgatcgcggtcttctacttgctgcggtgtttgtttgattaaatccttgcctgaagaaaaagtttggaaaagctgaccgtctaaatcgttgcggtcggtaaccactacaatggtaggatttttcaattcaggctgtgcaagcagtttgcctgcataaaacagcatcgaaatcgacttgcccgaaccctgcgtatgccacatcaccccaatgcggcggtcgcctttttctgaagtcgcccaaatggtggaatctaccgcttcatttacgccgtaatattgatggtacgccgcgatttttttaatggttttgccaacggaatcccgttcaaacaagacgaaatagcggatatagtccaataaatcctcaggctgcattaagccattgagcaggctttgcaactcatcgtcaaaatataagcgcgcgcttttatttttttcatcgaccactttccacggcgtaaagcgttggaaatctgccgaaagcgaacccaaacgggcgacaatgccgtctgaaataatcagagcttggttgtaaacaaacagctcggcaatttcatctttataggtttcaaattgattaaacgcctgcaacaaatccgccgattcacgcaacggatttttgagctcaaataccaccaacggcagaccatttacaaagccgataatatcgggaatccgtttacctcctttgcggctgcggatttccaattgattgacggcaacaaagcggttgtttccccaatgctcgaaatccaccaaacgcaccatctcaattttctgttcgccgttttgcgtatattcgacccgcacgccatcacgcagcagtttataaaacgtctgattacgcacaaccaagtcgccaatatcgcttttcgttgccgatttcactacagaatccaccgcactttcaggaagctgaggattaagtttacgcaccgcctcacgcagttgctcaacaaagactacgccgctcaaatcgccacgggcaaacttgccctcatgaacaggcaagtctttaccgtagcgatattcccaaccgagggattgcaggcgttgaagggtaagttgttcgatgtcattttcgttgagcataggtgttccttttgtgtatttgctgtctttggggagctaatagattaatttcttcgtttattggcagaagtgaaatcaatctcgtgagtaattaaatttccccattcaacaatctaggcagcaataaatctcttatttcagttagtctcttattttcaatagaatttgataaggtcttttcaaaaatagaaacaacttttttttgaaaaatatagataatttcttttgatggtgtaattatctctattttagagaatgtgcttgtgtttaaatttaaagttgcagtgccaccacttgccaaatcttttagatattttgtcattgatggctgttttaacgataaatataaaaactcacaggattgttcatcatctggaataattgaattaatttgttggtttgtatgagatggcttagatgtcattgaaaccaatccgacagtagcaatacaacttacacaaatgctttttgctggaatatattttttagattggtaatttgcacctactacactcaagttatctgttgtttgagtaataaatacttgattgtgcatatctggaatcttaataaatggcacatcatcaccataaaattctttgttggattttgatggtgttttcccgcagataatttgacctaaatctgataaggctttcatttcccaccccctcggcacctcaaccccatcaacctccaccccatcaacctccaccatctcacacggaaacgctttggcggtttcggctaattcggcgtagcggtcaggctgtgtttgtgaaagtgcggtcagttcttcgggtgtttttccgctgattgcctgcatggcggcaagttccgcttgttcaaggctcatgccgtccgaaagggcttgggctttggcacgcacgggatcgaaatcgacaaaccagcttttaaacagcgcttgggcgatttgttccaaggtttggttgatttgggtgttgagttctattttgtcatctaatggggtaataatatcaaggattttttgttgtgtttctttatctggtatatttaaagataaacttgaaaccgaatcaaatgtgatctgtggaaatgttccagatcttgattcagctatcattttaaaatattcggttgtttcattgctaattagtagtaaaaataggaattctggtaatacaatattagcattaggctcaattaccataaattttgtggaaacaacataattgtctaaatcattatctacaaataaatatcgtccattacctggtcttatttcactatatagaatatcgcctttttttatggctttcttagcttgccctggtaaatctttgacgtttgatatctcgcaatgtagaaatttattatttaatacatccccagtgttaataaatacaacatttgggtatgcattaaagtcaaaccttcttgatatatttcttgatatatcacccagagaatactctttccaatcactcataacccaatccccctaaattcttcttaatctcagcttccaattccgcactttttgcaaattgctccttcaaaagagcggtcagattttgcattttttctgcaaatggcacgccgtcgtcttcttgttctgcagtgccgacgtagcgccctggtgtgaggacgaagtcgttatttttaatctcttctaaagtcgcggatttgcagaaagcggcttggtcttcgtagccgtctgatgtttgccaagcgtggagggtatcggcaattttggcgatgtcgtcagcggtgaaatcacgcaatacgcggtctttcatatagccgatttggcgggcatcgataaataatacttcgcctttgcgctttttgttgcggtttaaaaaccaaatgcaggcggggattttggtgttggtaaagagctggccgggcagggcaaccatacattcgaccaggtcggcattgatgatggctttgcggatttcgccttcgttgttggtttggctgctcatagagccgttggcaagcaataatgctattttaccgtttggcgagaggtggtaaatcatgtgttgcagccaagcgaagttggcgttgcctttgggcggtgtgccgtatgcccaacgtggatcatcggcaagggattcattccaccattctttatcattaaaatgcggattcgccataataaaatccatctttttgtcgatgtgttgtggctgggtgaaactgtcggcgttgtatttgccgaagtcgtaatcaatgccgcgaatygccatattcatggcggcgagtttccaagtggtcgggttgaattcttgcccgtagatggaaacgttgttgatgttgccttgatgggcggtgataaagcgttcggtttgcacgaaaaagccgccactgcccatggctgggtcatacacgcgtcctgaatagggttcgagcatttcgacaatcagggaaacaatggatttcggtgtaaaatattgccactgcgtttssttcggcttgagcaaatctgctgaggaaatattcgtaaacgtggccgagaatatcttttgcgcctaaatgtacgggctcgccgttgtaagttgggcgggtaaagtgggtatcggagaagaggataatcagcccgcgcagggtgtcttcgtttacggcatagccgctgatgcgttggagtacgcctttgagtttttcgttgtctttttcaatggcatcgaaggcatcgtcaatcagttttgccacaccagaaaattttccaccccaaggcaattctgccccagtgttgagaatagagacttcttgtaaggcttgccaacgtgcagaagctggcacccaaaatacgttatcagcggtgtaataatcacggttttctagttctgcggttaaggcttcttgatattcttcttcagtatcaaaaaaagtgcggtcaagatagaggggattttcaggtgtggagagttccgcctgaattttttcctgttgatgggtgaaactatcggaaatgtattttaagaagataagaccaagaacgatatgtttatagttagcggcatcaagttgtttgcggagtttatcagcagatgcccaaagtttttcgtctaawtcatttaaaaatgcttgttgtaatgtgtgatttttatcgacaatcttggtcgtctcgtctcgtctcgtctcgcttgcataaattatgccctctgtaaagtgatttttatcggaagtttgaatattcaaacaaattatcaggtgtcattttatcgaaaaacagtattaagttgaaagggatttttgcgtgctaaattcaatgatttccagtagaatgaggcgcttttataaataaggaataactatggcaagagaatttaaacgtagcgaycgcgtcgctcaagaaatacaaaaagaaatagcagtcattttacaacgcgaagtgaaagatccccgtattgggatggtgacggtttctgatgtggaagtgtcaagtgatttatcttacgcaaaaatctttgtgacttttttattcgatcacgatgaaatggcaattgagcaaggcatgaaaggcttagaaaaagcatcgccttatattcgttcattactaggcaaagcgatgcgtttacgtatcgtgccagagattcgctttatttacgatcaatccttagtggaagggatgcgtatgtcaaatcttgtgacaaatgttgtgcgtgaagatgagaaaaaacacgttgaggaaagcaactaatgtctagacctcgtaaacgctggcgtgatgttgatggtgtgtttttgttggataaaccacaaggcatgtcatcaaatgacattatgcaaaaggtaaagcgtttatttcaagcgaacaaagccgggcatactggcgcgctcgatccgttggctacgggaatgttgccgatttgcttgggggragcaactaagttttcacaatttttgcttgatgccgataagcgttatcttgttacggcaaaattaggcgaacgtaccgatacttccgatgcagaagggcaagtcgtggaaactcgtgaagttaatcttgaaactcagcaaattttgaccgcacttgaacaatttcgtggcgatattttgcaagtnccgacaatgttttccgcactaaaacataacggcaaaccgctttatgaatatgcgcgccaaggtattaccgttgagcgtgaggcacgtccaattacgatttttgaacttaattttattgaatataatgcgccttttttaaccttagaagtgcattgttcaaaaggcacttatattcgcaccttagtagatgatttaggtgaagtgctaggttgtggcgcgcatgtnacaatgttacgccgtacagccgtagcggattaccccgtagcagaaatgatgccaatcaatgagttacaactgctcgctgaaagttttccattaagtgaattagatcgtctattactgccaaccgataccgcagtaagtaaattgcccgctttgcatttggatgcagagcagagtaaagccattggttttggtcagcgagtgaaatttgctaacgaacagcaattaagtggtcaagtgcggttattttcagcggagaatttattcttaggcgtacttaatcgacgggaatattattcgcccacaacgattaattacacaatccgcataacttcattgcctttcctgtaaaattctagtaatctccttgtaattaattttttacaatatatgtaagataaaaattacaggtgagttttatggaagcccttaaagatttacgttctgaaattgattcgcttgatcgcgaacttatccaactttttgctaaacgtcttgagttggtttctcaagtcggtaaagtgaaacatcaacatggattacctatttatgcgccagaacgtgaaatagcaatgctccaagcacgtcgtttagaagctgaaaaagcaggcatttcagccgatttaattgaagatgttctacgccgttttatgcgtgaatcctatgccaatgaaaaccaatttggttttaaaactatcaattctgatattcacaaaattgttattgtgggcggttatggtaaattaggcggcttatttgcccgttatttacgtgcatctggctatccaatttctattttagatcgcgaagattgggcggtggctgaaagtattttagcgaatgctgatgtcgtgatcgtttccgtccctattaatctcaccttagaaacaattgaacgcttaaaaccttatttaacggaaaacatgctacttgcagatttaacctctgttaagcgtgaaccgctagcgaaaatgcttgaagttcatactggtgctgttttaggtttacatccaatgtttggtgcagatattgcaagtatggcaaaacaagtggttgtgcgttgtgatggacgttttcctgaacgttatgaatggttacttgagcaaattcaaatttggggtgcaaaaatttatcaaaccaatgccacagaacacgatcataatatgacttatatacaagccttgcgccatttttcgacttttgcgaatggtttacacctttccaaacagcccattaatctcgctaatttattggcactttcttcccctatttatcggttagracttgcgatgataggtcgtttatttgcgcaagatgcagagctttacgcagatattattatggataagtcagaaaatttagcggtaattgaaacgctaaaacaaacttacgacgaagccttaactttctttgaaaataatgatcgtcaaggttttattgatgctttccacaaggtgcgtgactggtttggcgattattccgaacaatttttaaaagaaagccgtcagctattgcaacaggcaaatgatttgaaacaagggtagagaaaagtgcggtgaaatttcaccgcagttttttactgtctcgctaatcttaaattttcaggtaaattctcaaaattagagcggaatggattaatgtctaatccgccacgacgggtatagcgtgcgtaaacggtgagtttttctggttttgcgtagtgcattaaatcgcaaaaaatacgttcgacacattgttcgtggaattcattatgttggcggaacgatacaacgtaacgcaataatttttcctgattgatttttttaccaacatagtgaatatgcaaggtgccccagtctggttgattggtaatgaggcagttagatttcaataaatggctgactaatttttcttcgacaatttcatccgatacgcaatctttcagccaattagcgttaaattcgtagctagtaatttcaatatcttgttcatcaatgcaatcgccttgtaaatgatcaattttttgagaatcataaactgccattggatttaaccgcacttttacatcgccttgcgcacattcgcttaaatcacgttgcatagtttgttgaacggcgttgaagtcggcaaatttgctttggttaaagctatttaaataaagtttaaaactttttgattcaatcaaattttggctttgataatccagataaatatctgcgatagccacttgcggtaagcctttttcgttgagccacgagatttcataagccgtccaaatatcggcgccgatagtaaatggttggttttgagtaattcccaatccatcacgatttaacgcgcgtggcactggctgtaataaagtgcggtcatattgagaggcatattccgttttttgaccgagttttaaggattttaagctgttgtcttggtaattcatttatttttcctttatatgttaaaaaataattttgccttcccttgcttgcgggggaaggtggcgcgaagcgtcggaagggggctaagactttatcattccaacagagagttgaggcatcgacttaaattacaaaaaattccacgatagattcgaaactaatcgacaggtatcgcatttaaaatgaaaggtatcaaaaatcgcgtcttttaacgcccaatttgcaccacaagaagggcagcaacgggatttttcagattttaaagattgcccacctacacgatataaataatagtaagtcggtatgccagtttctttttctatttcttgggctaaatatcgtccgtgttttgaaagcgtactttgatgatcggaaatttctgccaaagattgttgttctaatactgcaccattcatttgtagttgatcgcaggcttgccaattttcttgccatttaatcagatcttgggttaagtgcggttgattttttagttgtttatacaaagggatgggtgcgaaattttctccactatgaatcggcgagcaactttgtaaatgggttgtgtaaagcacttgccaagctggcgacgcattttctgctgtttgatctgaattgaaatcatcacccacaagttgaaaaccatcaaaaattacaccgcacttttcggcttcttgtaatgcccgattcacttctgcgttattattttgtgggaaaagactatcttgctcagggcaaatgacacgcatagcaaaaccttgtgcgccatcttcttccgctaaatataaaggaatttcacgtccgataatttgcccgttataccgccattgatcgatcactgcattgagtaaacgactttgtgattcaatattattttcgagcgcagtcaggcgaaaataggtttcgattaaatacataaattttttaattgctgtccgatttggtttaagccgtttaaacgcatttcacttaaacgttgtgaaatgccgagttcgctaaaaaatacagtaatatcaaatgtattcaattcatccgctgttttgccattgatttgattgaataaaatccaaagtaagccattcataattctggcttcgctaaatccgctgaattgaaaagtgcggtcatttttaggcataatttgaaaccacatttgtgcttcgagccagtaataggttgcatttgagcgagttcattatcgcttgggcgaggtaaatttttgcctgcttgaataatcaggcgatagcgatcttcccaatttttagcttgttttaattgttctatcattgtaataaatccagtgctttatctaaggcggtgaagaatgcctctacatcttcttgtgtattataaggggcaaaagacaggcgtaatgtggtgcgttcgcctaagcgtgctaaataaggctgggcacaatgttcgcccacacgaagcgcaatattttgttcgctcaaaagtgtagaaagatcagaacagtcaatgccatcaaatacaaagcaaacaacggtgcttgcttgaggagaattgaataatcggcaattctcgtaagattttaaccgcactttgacggattcagccaaggatatagcgtactgttctgcagcggtaaaatcccatttttgtagccaatccagcaccgcattaaagccaataaccccagcaatattgggtgtgccagcttctaaacgataaggcaattcggcaaaagtaatacgatcatttgatacacgatcaaccatttttccaccgaaaaagagcggttgaagttgagaaagtgcggtcaattttcctgttaaaacgccaagcccatttgggccataaattttatgggcagaaaatgcgaggaaatcggcatctaaatcttgtaaatcaattttgatatgactaatcgcttgtgctgcatccactaaaaccaaggcattgctatgttttctaataagttgaatcaggcgtttaatcggctgttctgtgccagtgacatttgaaacaaaatttagcgcaacgagttttgttttttcagaaagggctgaaatcagcgcattttcatcaattagccaattatctaaaatcggtaaaacttgaatttttgcaccgcactttttcgccgtttcatgccaagtgacaaaattggcatgatgatctgcttggctaatcagaatttcatcttcggcgtttaattgcggcatcaatccatttgccactaagtttattgcgtgagttgtacccgaagtccaaataacagcgtgtttatcttctgcatgaacccattctttaacttgtgtgcgagcctgttcatattgcacagtttgggcagcatcatattggctgcgatgcaccgaacctgcagacgcataaaattcagcggtgcgatcaattaatacttgaggtttcaacgtggtggcggcgttatctaaataaataaccgcatcttcacgttggaaatagggaaatgcttgacgggaacgtttgataatcaaaagccatattaattttctcttgtctgcgccattgacttggttcaattggattattgtctgcccaaagaccaattcctttggcttgtgcattttcttgtgcttgaagataaatcggatcatgggaatattgcttataagcccatgccataccctgtttaaccatttctaaattaatattttgtttttgataataaaccaccgctaaggtgcgttgatagcgatcttttccttttcgcgcaaggcgaacatttttttgataaaccagatcagacaaggtttttttcgatttttgcccaaaggcttgagatttttctggcgcatcaatttcggctaaacgaactttaatggatttattgcctttagtgaggcaagtgagcgtatcgccatcactaattttaaccacacgacacgtatttttttcgcgagaacaagcagaaagtacggtaaaaataagtaataaactcgtcaatagtatttttcgatttatcattttgcaaagtttttgatctaagtctggttattttaccgaaaaaatggctcaagttagcaaaaaaaagcgtaaaataattttgaaatattatgaaaatagttgaaaaggttgtatatgattaaaaaattatttttattagttcgttcgttggtcattttatctattatgttatatctcggaaatcttattgcttattacattccatcaggtgttccaggaagtatttggggattgttattgctctttttaggtttaacaacacgagtgattcatttaaattggatttatttaggcgcaagtttgctaattcgttttatggcggtactttttgtaccagtgagcgtgggaattatcaaatattctgatttattgatagagcaaattaatattttgcttgttcctaatattgtgagtacttgtgtcactttacttgttataggatttttaggtcattatttgtatcagatgcaatcttttacacataaacgcaaaaaagtaataaaacgtagagaaaatcaggtaaaacaagcgaattagtatgttaggaaagtttatatgcagcagtacattatttatctttatacatttttaacaatttttgggttttggctcgcactacaaattagcaaacgttggaagtcaatgatttttaatacttttgttttaacagtattaattttggcggcgattttagtgataggaaagattccttatgatgattatatggcaggaaatgcgcctattaataatttacttggcttgagtatcgttgctctcgcattgcctctttatgaacaacttcgccaaattgccagacaatggaaaattattctttcaacggtggttatagcctcttttttggcgatgttaagtggcgggcttttagcacttcttttaggctcaacgcccgaaatggtcgctacggttttacctaaatccatcacaatgcctattgcgatggaagtttctcgtcatttaggcggcattcctgccgtaactgcagttggtgttgtggttgcaggtttgcaaggatcgatatttggttatcttgtattaaaaaaattgggtgttaaacatcaagaagctattgggctttctgttggttcggtttctcacgcgctcggtacagtaagttgtatggaaacgaatccaacagcgggaagctacagttctatttctcttgtgctttgtgggattattagttctattctcgcgccatttgtatttaagctgatttatttctttgtttaaatatcaataaaaattcaaccgcactttattcattttagattgcgtttgttatagataaagtgcggttgttttttgcgctaaatgattagataatgcagaaaaacgaaataaaacaaagcgatatgaaaccacttatcattgattcttcttggacagaacgttttcttcctgatcctccacgcgaaaaagataatcgtccaccatttcgtcgtgatcgtgggcgaattttacattctgctgcttttcgttgcttacaggcgaaaactcaaattcactcaattggcgaaaatgatttttatcgcactcgcttaacccattctttggaagtggctcagattggcagtagtcttgttgcacagcttaaatttttagaaacctttgaaagcctttcacaaacattaaatattgataaaaacgagttgcaaaaacaattaaaacctttattgccgagtaacgatcttattgagagtttgtgttttgctcatgatattgggcatccaccttttgggcatggtggcgaaacggcattaaattatatgatggcagagcagggcggctttgaaggcaatgcgcaaacctttagaattttaacaaaacttgagccttacactgaaaatgcagggatgaatctaacacgtagaacactattgggtgtcgtgaaatatcccgcattgttagatgtgcttcgcctcaatatgcagaacttaatttttctcgcaatattgatcctcgttttgtgcgtattcacgattggattccaggaaaaggcattttccgtgatgatttaaaaatgtttaattggttgctggaaaatctttctgaaaatgaccgcactttattctgtcaatttaaaaaagtgcgggaaaatccagctgaatctttacatactcggtttaaatcgctggattgcagcattatggaattggcagatgatattgcctatggcgtacatgatttagaagatgccattgtgactggcatggtcaatcctcatcaatggcaagcggcacattccgcattgaaacaaattccatcagcttggttgcatgaaaatattgattcaattagccaacgacttttctctgataaacattttgaacgaaaacaagccattggtgcattggtgaacttttttattactaatgtgcggtggaaattaacggcaaattttgatgaacctttgttacgttataacgcagagttgttacctgaagtgattattgcacttgtgtatttaaaaaatttgtttgggattatgttattcgcaatgtagatactcaacgaatcgaatataaagggcagagaatgctaacagaaatgttccaaatttttgaatctgatccagagcgtttattacctcgaaatactgcaaatcgttggcgtaatgcccctgaagaaaggaagaagcggattatttgcgattatattgcaggtatgtcggatgcacacgcattacgggtatatcaacaactttgatttaagagagaatcccatcgaattgatgggattttttatgcaaaccgtatagaatagtgcggttaattttcactgaatttttatggggcagctgtggcattaattagtttaaccaatggatacctttcctttagtgatgcgcctttgttggatcacgcagaactacatattgaaccgaatgaatgtgtttgtttagttgggcgtaacggcgcaggtaaatcaactttattgaaaatcatcgcaggcgatgtgcttatggatgatggcaaaatccaatacgaaaaagatcttgtggtttctcgtttagaacaagacccaccgcgtaatgcacaaggcaatatttttgattatgtcgcggaaggcgtagggcatttaacggatttattgaaagaatatcatcagatttctgttcaattggaagaaaattacagtgatcaaattttaagtcaattagagcaagttcaggctaaattagaacacgctgatggctggcgatttgaaaataaaatcaatgaagtattgttaaaactaggtttaaatccaaacacaaaattatccgcactttcgggcggttggttacgcaaagcggcactagcacgtgcattggtgtgcgatcctgatgtgttattacttgatgaaccaaccaaccacttggatgtggaagctattgaatggctggaaaatttcttactggatttccaaggtagcattgtatttatttcccatgaccgttcttttattcgcaaaatggcaacacgcattgtggatttagatcgcggtcaattagtgtcttatccgggcaattacgatttatatttaactacgaaagaagaaaatctacgtgttgaagccttgcaaaatgaattatttgataaacgtcttgcacaggaagaagtgtggattcgccaaggtatcaaggctcgccgtacaagaaatgaagggcgagtgcgagcattaaaagtgatgcgtgaggaacgccgccaacgccgtgacgtaatgggaacagccaaattacagttagatacctcaagtcgttctggcaaaattgtctttgaaatggaagatgtgagctatgaaatcgcaggaaaaaccttgttaaaagatttttcaacaacgattttacgtggagacaaaattgcgcttgttgggccaaatggctgtgggaaaaccacgttcattaaattattgctgggggaaattcagccaacatcaggaaaaatccgttgtggtaccaaattagagattgcttattttgaccaataccgtgctgatttagatcctgaaaaaaccgtaatggataatgtggcagatggtaaacaagatattgaaatcaatggtgtaaaacgtcatgtgctagggtatttgcaagatttcttgttcccgccaaaacgagcaatgaccccagttaaagccttatcggggggagaacgaaatcgtttattactcgcaaaattattactcaaaccaaataatttattgattcttgacgaaccaaccaatgatcttgatgtagaaacattggagcttttagaagaaattttgacggattatcaaggcacattgttaattgtgagccacgaccgtcaatttatcgataatactgccacagaatgttatttattcgaaggtaaagggcatttgaataagtatgtgggagggttctttgatgctaaacagcaacaagccaatttctgggcaagtaaagcagtggaagagcaggctaaagcgaagaaatctgaaccactaaaagaagaaagtgcggtgaaaaatgaccgcacttctaagccgaaatccgtgaaactttcttataaagaacaacgagagctagaacaacttccacaactattggaagagttggaaactaaaatcaccgtacttcaagctgaaatagccgatccagcatttttccaacaagctcacgatattaccgacgctaaattaaaagcattggcggatactgaagccgaattagaaacagcatttttacgctgggaagaattagaagaaaagaaaaatttggttgaaggtaaagcttaaaaaaataacgcccgaaagggcgtttttttatgtattttcaagatgatcttttttcaaaatattttcttcatcaagtattgataaacgagcgatagcgtttcgataagaaatttcaagggtttctctgctggttgccattacgccttgatccactaaaaatccatcatttacatcatatacccagccgtgtaatgagagtttttgtccgcgttcccaagcactttttacaattgatgtgcgccctagattgtaaacctgttccgctacgttaattttagttagcatatcggcacgtttttctggagaaagtttaccgagaagatgaccgtgtttaaaccaaatatcacgaatatgaagaagccagttgttgataagccctaaatctttatctgccatagcagcatgaatccccccgcagttggtgtgaccacagataataatatgttcaattttaagcacatcgacggcatattgcacaacagaaaggcaattaaaatctgtgtgaattacttggttagcaacattacggtgtacaaaaagttcgcccggttcaagatttgtcaatttttcagcaggcacacggctatcagagcaaccaatccaaaggtaatgtggcgtttgatgatccgcaagttctttgaagtaagtagagttttcttctttcattctttgcgcccaactgtaattgttggcaaagagttgtttaattttatccattttactttccttaaaattctgaaaaaattgaccgcactttggcgtaagtacggtcaatattaaagttaaattgaattagaaattcgcatttcttggtgcgcgtgggaatggaattacatcacgaatattttgcacgccagttacatagacaattaagcgttcaaaaccaagaccaaaaccagaatgtggaacactgccgtatttacgaagatcgcgataccaccaataatcatctggatttaatcccatttcttccatgcgtttatcaagcacctctaaacgttcttcacgttgtgaaccaccgatgatttcaccaattcctggggctaacacgtccattgccgccacagttttttcatcatcatttaaacgcatatagaatgctttaatgtcttttggatagttttttaccacaactggtgatttgaaatattcttccgctaagaaacgttcgtgttcagaagaaagatcaatgccccaagaaacagggaattcaaatttcttaccagattttaataacacatcaatggcatcggtatagtcaatttgcgcaaaatctgagtttacaaagttttctaaacgagtaataacatctttatctacatgtttttcaaagaattgtaagtcgtctttacgctctgctaatactgcacggaatacgtatttcaacatatcttctgcaagttttgcgttatccgctaaggttgcaaatgcaacttcgggttcaaccatccagaattccgctaagtgacgggtggtattagagttttctgcacggaatgttgggccaaaagtataaattttgcttaatgcacaagcataggtttcgccgtttaactgacctgaaaccgttaaaaatgattctttaccgaagaaatcttggctgaaatcaacttttccattttcactacgtggaagattttctaaatcaagtgtagaaacacggaacatttcacccgcaccttcagtgtctgatgcagtaattaatggggttgccacccagtagaaaccttgctcatggaagaaacggtgaattgcttgagataagcaatggcgaacacgtgcgaccgcgccaataatattggtacgagggcgtaagtgagctacttcgcgtaaatattcgatagagtggcgttttgctgccattgggtaagtatcaggatcttcaacaaaccctgtcacttccactttttctgcttgtaattcaaccgcttgtccttctgcaggtgattcaacgactttaccggttacaatcacagaacagcctgttgttaaacgtaaaatttcgctttcgtaattttcaatatcgttattaataatcgcttgaattggatcaaaacaagaaccgtcataaaccgctaagaaagataagcctgctttagaatcgcgacgggtacgaacccaaccacgcacagtgacggtttcaccaatcgccactttcccttgtaatacatcaacaattgatgccactttagacatattaaacctctgtaactgaatgtaattcatataaaattgccgatagtttaccttaatgaaggaaattttccataaaaatatagtgttggtgcgggttatgaacaataaaatcgccttaaaaatgagtcctaaataaaatagggtaaagccttattaatattgaatatacgcgattttatgttaaaatctcgggtcaaatcattatggctaataataggaaaaaatatgaaagttttagaaggctcagttgcagcacctaatgcaaaagttgcagtagtaattgctcgttttaacagttttattaatgaaagtttattagaaggcgcaattgatgcattaaaacgtatcggccaagtgaaagatgaaaatatcactatcgtgcgtaccccgggtgcgtatgagttgccattagttgctcgtcgtttagctgaaagtaaaaaatttgatgcgattgtggcattaggtacagttatccgtggtggtacagcacattttgaatatgtagcaggagaagcaagcagcggtttaggaaaagttgcaatggatgctgaaatccctgtcgcttttggtgtattaaccacagaaaatattgaacaggcgattgaacgtgctggtactaaagcaggaaataaaggtgcagaagcagccttaactgcacttgaaatggttaatcttattcaacaaattgatgcggcataaatcatgacagaacaaaaacaagtgaaaaagccttctgctcgtcgtcgtgcgcgtgagtgtactgttcaagccttgtattcttgggcggtatccggtaatactgcagaacaagtggaattagcctttgtgttagatcaagatatggatggggtagataaaccttacttccgtaaattatttcgtcaaacaatagaaaatattgaaaccgttgatttttcaatttcgccttatattgaccgcgcttttgatgagcttgatcctattgaaacggcaattttacgtttggctgtttatgaattacgctttgaattagatgtgccatataaagtggttatcaatgaagcgattgaagtggcaaaagtattcggtgcagatgaaagccataaatatatcaatggcgtacttgataaaatcgcaccagcattagggcgtaaataatccttttaaactgagaatggcgcgcgtttttaatgcgtgccttttcttttataagataggtggaaaaatggcaatgggtgaatttgatttaattaaacgatattttcagcaacaaatattagttgatgattccgttcaattatctattggcgacgattgtgcgctggtttccgtgccagagaattatcagcttgccattacgaccgatacaatggtggaaaatacgcattttttaccaaccatttcacctgaggacttggcttataaggcggttgcaacaaatttaagtgatcttgctgcaatgggggcacagccaaaatgggtttcactggcattaactttgccaaatgtagacgaaaattggatttcaacatttagccaaagtttattacacacgttaaaacaatacaacgtcacattaattggtggcgatactacaaaaggtaatttgtctattacgattacggcacaaggttttgtcgaaaaaaacaaaggaatttgtcggcataaagcacaaatcggtgatttaatttatgtttcaagcactttaggcgatagcgcggcaggtttaacacaaattttattgggcaaaagtgcggttgattctgatgatgtttttttgcaacaacgacatcttagacccacacctagaattgaacttgggcaggcgttaattggcattgctcatgttgccattgatctttccgatgggctaatatctgatttagggcatattcttgaacgaagtcaatgtagtgctgaagttgaattgactgcattacctctttcatcatcgattttaaataaatatgatcgcactcaagcggaacaatttgccttaagtggtggcgaagactatgaactttgttttaccataccgcccgaatataaagatgaattagaattacgcttgaaaaaactgaacgtgccttgcacttgtattggtaaaattaatgaaaagtgcggtgacttttctccccgttttttacgggatggaaaacctgtgaatataactttttcaagcggtttcgatcattttaaggaatcaaaatgacagaaaataatcctcttaaaaaaatctctcttttaaatcctattcatttacttgccgttggttttggctcaggcttaattcatcctgctcccggcacttgggggagcttagctggaacaattttaggtgtgattttactttccttattaggcgtaaaaatctttttaattttcaccgcactttgttttctactcggttgctacctttgccaaaaaactactgcagatatgggcgtacacgatcatggttctatcgtctgggatgaatttgtcggcgtatttattgtattagcagcgataccgtcattatcttggcaatggattttggctgcttttgcgttattccgcttttttgatattttaaaaccgtttccaattcgttattttgacgaaaaactcgaaaatggttttggcattatgatcgatgacgttttagcggcaatttatgctgtgattgttgtatttgctattcaatattggatgttgtgatgctaaatttaatcattgtgcatttatttggattaatgacgccagggcctgatttcttttatgtaagtcgaatggcggcaagtaactctcgtcgtaatacagtttgtggcattttaggcataacgcttggcatcgccttttggggaatgctttctatgttgggattggcggtgttgttcgttaccattccagcattacatggcgttattatgttgctaggtggtagttacctagcatatctcggttttttaatggctcgcagtaaaaaatacgctaaatttgaatcgcactctgatactgaatttaatcaacaaaccacaatcaaaaaagaaattttgaaagggcttttagtgaatttatccaatgcaaaagtcgtggtgtattttagtagcgtgatgtcgcttgtcttagtaaatatcactgaaatgtggcaaattatcttggcttttgcagtgattgtggtagaaacattttgttatttttatgtgatttcattgattttttcacgtaatattgccaagcgtttatacagtcaatacagccgttatattgataatatggcaggtattgtatttttattttttggttgtgtgcttgtttataacggcatcaacgaaataattcattaatagaaaaggaagtaacatgacattaaaaattgcaatcgctggtgctggcggaagaatggggtgtcaattaattcaagcggttcattctgcggaaggcgtagaactaggtgcagcttttgaacgcaaaggatcatctttagttgggacggatgcgggagaattggcgggaattggtcatcttggcgttgcagtttcagacgatcttgaaagtcaaaaagataaattcgatttattaatcgattttacccgaccagaaggcacccttgaacatattgcattttgcgtagcgaataataaaaaaatggtgatcggtacaacaggttttgatgaaaatggtaaagtggcgattaaagcagcttcagataaaattgctattgtgtttgcatcaaatttcagtgttggcgtgaatttagtcttcaagcttttagaaaaagcggcaaaagtgatgggggattattgcgatattgaagtgatcgaagctcatcaccgtcataaagttgatgcgccatctggcactgcactttctatgggcgaacatatcgcaaaaaccttaggtcgcgatttaaaaactcacggagtcttctgccgtgaaggaatcacaggcgaacgtaaacgcgatgaaattggtttttcaactattcgtgcttcggatgtggtgggggaacactcggtttggtttgcagatattggcgaacgtgtagaaatttcccataaagcatcaagccgaatgactttcgctaatggtgcagtgcgtgctggtaaatggttagaaaataaggcgaatggcttatttgatatgaccgatgtattagatttaaataatttataaatcaatttcaatgtcactttctacgtgacagcaacataataaaatctcatcaggttgaataaaggcaaggggcatttctttataagacaccttgccttttttgatcttaacgcgacaagaaccacaatagccactacggcattgatattcgtgatgaatattatttttctcgagatgatcaagtaaacttgtttcattattgaattctaatgtggtgttatggcggataaggtggattttcataataacgatatgttgtaatttgtcgtgctattatataaggaaaagatgaaattattgataaaaacttcacttagtcagtggatttgcttgaattttgccaaaatccctatttttaaaatgctaggttttataaccgcactttttattactgcttgtagttctattagcaaagaaccagtgaagacggtggatatttatattaaaccttattattcggctgaaaatggaaaagcagaaaatgtatttgtacataaagaaattgatcctatgctacgtgaaaatacgataaaaggttataaaagtgcggtgaaatttgtagaagaaaatccagctcgtatttcaccaatgacgatgttcacgttagctgctcgggcttacgattttggcttaagagatgaagctgttacttggttttatcgtgggcaaaatcgcttgatcaccgcactttatgtgttggatctaccaaaacaaacggtgcaggataatacagggttcagccatgttgtagggcagtttgttaatgcttatgcgttttgcaattttgataaacaaagtcttgctgccgaaaatgcaatgaaatggacagttgcgcatccttatgaagtggttttcttaccagcattacccgcaaaatttgcagatcgtcaaaaagcgttgaaagaagcagaagaaaaattagttcaacgtttacaggaacaagcccgtttttttgctaatccaaaaaataaagaaaaatggcaaaaagagcggtcagaaaattttgtgaatgaacgattttgttggtaacaagaaaaaatggaatagcgaatacgttattccattttnatttttgataagccaatgattttncgcattattcttttactttttaaggacttggtattatcattactcggttttttattttatagagaaaagagaagcaggggaaactatgcaacatctgaacgagcttgttgagaaagcgaaattagcgattgaatccattcaggataaaagtttaacggctttggatgaaatccgtgtcgaatattttggtaagaaagggcatttcacgcaattaatgcaagagttgcgtaacgtgtcagctgaagaacgtcctgcgatgggcgcaaaaattaacgaagcaaaacaagctgcgttagaatttttaaatgcaaaaaaaacggagtgggaacaggctgaacttaactcaaaattagaaaaagaacgtgtagatgtcagtttacctggtcgcaaagttgaaaccggtggcttacacccagttaccatgacgattaatcgcgtaacaaaatttttctcagaacttggcttttcagttgaaaatggtcctgaaattgaaagtgattattacaacttcgatgcgttaaatattcctaaacatcacccagcacgtgccgatcacgatactttctggtttaatccagaattattacttcgtactcaaacttctggcgtgcaaattcgtactatggaaaaaatgcagccaccaattcgcattatggctccaggacgtgtatatcgtaatgactacgatcaaacgcatacgccaatgttccatcaaattgaactactttatgtggataaaaaagcaaatttcacagaattaaaaggcttattacacgatttcttacgcgctttctttgaagaagatttacaagtacgtttccgtccatcttatttcccattcacagagccttcagcggaagtggatgtgatggggaaaaacggtaaatggttagaagtgttgggctgcggtatggtgcatccaaatgtgttgcgtaatgttggtattgatccgaatgaatattctggttttgcagtgggaatgggcgttgagcgtttaacaatgttacgttataacgtaacagatttacgttcgttctttgaaaacgacttacgtttcttaaaacaatttaagtaatttctcggatttgaattaaaaggataacaacaaatgaaatttagtgaacagtgggtaagagaatgggtgaaccctgcggtgtccaccgagcaattatgcgagcaaattaccatgcttggcttagaagtagatggcgtggaagccgttgcgggtacatttaatggtgtcgttgttggtgaagtggtggaatgtgcacaacatccagatgcagataaattacgtgtaactaaagtgaacgtaggcggtgatcgtttattggatatcgtgtgcggtgcaccaaattgtcgtcaaggcttaaaagttgcttgcgcaacagaaggtgcggtattacctggcgatttcaaaattaagaaaacgaaattacgtggtcagccatcagaggggatgctttgttcattttctgaattaggtattgatgttgaagctgatggtattattgaattgccacttgatgcaccaattggtactgatttacgtgaatatttagctttagatgataatgccatcgaaattagcttaacgccaaaccgtgcagattgtttgagcattgcaggtattgcgcgtgaaattggtgtggtaaataaacaactcgtaaatcaactgcactttgaagcagcgccagcaacaatttctgataaagttcaaattgatttacaagcaccagaagcttgcccgcgttatttattacgtgtgataaagaacgtcaatgtaaaagcaccatcgccaatgtggatgcaagaaaaattgcgtcgttgtggtattcgttctatcgatcctattgtcgatattactaactatattttgcttgagttcggtcagccaatgcacgcgtttgatgcggctaaagttacacaacctgttcaagttcgcttcgcgaaagagggggaagaattagtattattagatggctcaaccgcaaaacttcaatcaaatacgttattaattgctgaccaaaatgggcctttagcaatggcagggatctttggtggtgcagccagtggcgtgaatagtgaaacgaaagatgtgattttagaatccgcatttttcgctccattagcgattgcaggccgtgcaagacaatatggtttacatacggatgcatcgcaccgttttgaacgtggtgtggattttgaattagcgcgtaaagcaatggaacgagcaacggcattattacttgaaatctgtggtggtgaagcaggtgagatttgtgaagcaagcagtgaaactcatcttcctaaagtcaatacagttcaacttcgccgtagtaaattagatgcacttttaggtcatcacattgaaacaggaagcgtaacggaaattttccaccgtcttggttttgatgttacttatgcaaatgatatttggacggtaacttctgcaagctggcgttttgatattgaaatcgaagaagatttaattgaagaagtggcgcgtatttatggttataacagcattccaaacaatgcgccattagcgcatctctgcatgcgtgagcacaaagaatctgatttagatttagctcgaattaagaccgcacttgtggatgcagattatcaagaagctattacttatagctttgtggatccaaaaattcaaagtttattacatccacatcaagaagcacttgtattgccaaacccaatttctgtggaaatgtccgcaatgcgcgtgtctttaatcagcggtttattaggtgcagtgctttataaccaaaatcgccaacaatcccgtgttcgtttatttgaaacaggattacgttttgtgccagatgccaatgctgaatttggcgtgcgtcaagaatttgttttaagtgcggtgattactggaacggcaaaatctgaacattgggcaggtaaagcagagtctgtagatttctttgatcttaaaggcgatttagaatcagtactttctttaacagaaggtggtcatagagttcgttttgttgcaaaacaatttgatgcattacaccctggccaatctgctgctattgaattagatggtcaagaaattggttttattggtgcaattcatccatctattagccaaaaacttggcttaaatggcaaaacttttgtatttgaaattctttggaatgcaattgcggcacgtaatgtggtgcaagcaaaagaaatttctaaattcccagcaaaccgtcgtgatttagctttagtcgtcgcggatagcgtaccagcaggggaattaatcgcagcatgtaaacaagcaggtggcgaaaaattggtgcaagtgaacttgttcgatgtatatcaaggtgtgggcgtcgctgaaggctataagagtttagcgattagcttgactgtccaagataatgaaaaaacacttgaagatgaagaaattaatgcagtgatttcagcagtattagcggaggtaaaacaacgctttaatgctgaattaagggattaatatggctacgataactaaacttgatattattgaatatttaagcgataaatatcacttatctaaacaagatacgaaaaatgtagtggagaactttttggaagagatccgcttatcgctagaatctggtcaagatgtgaaattatcaggatttggtaattttgaattacgcgataagtcatctcgcccagggcgtaacccaaaaacaggtgatgttgtgccagtttctgctcgccgagtagtgacatttaaacctgggcaaaagttacgtgcccgtgtagaaaaaactaaatagtaagcaacaaaaagtgcggtgaatttctaccgcacttttcatatgaaaaggtatgaaagtatataaatcatttttaatcgctactgcatcgctgtttttattcgcttgttccagttttcaaaacgatgattatgcgatgaactataaaggtcaaatcggcgaacctattatggccatagccatgttgagcgaacaacaacatgaatgggcaggtacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaagatattcaaactggcgatttaattttctttaaaactggcagaggccctaatggttatcatgtggggatttatgtaaaagaagataaattccntcatgcttccaccagagggggagtcgtctattcttcaatgaataacccttattggtcgaaagccntctggcaagtcagacggatttaaaaagtataatgctggaattttccagcatttttttattgttttttcaactgctagaaaataaaaaccattaaatttatcttcaattattatttctgtganccatctcacaatcttaatatgacaattatcataaccctttagagcgcgttatattatctttatgctgtgttagtcgatatgggagaacaatatatgcttacgacgatactcagcttcctcattgtaaccactgtggttgcgtatgtttcttggttaaaaacaaaaggggatgatttaaaatcttcaaaagggtattttttggcagggcgtgggttaagcggtttagtaattggctgctcaatggtgctgacatcgctttcaactgaacaacttatcggtgtcaatgcggtgtcctataaaggtaatttttccgtgattgcttggacagttccaacggttattccgctttgtttcttggctctttatataattggctggctataacacttatgttgtaggaaagtggcacgtaggtacgaaatccgtacctgaagattacgggattaaaggccataactttgatggttatggctatcctggtagtggcgtatataaaaatttagtcttcaaccaaccgccaacacactctaatcgttataaagaatggttagaagaaaaggggtatgaaatcccagaagtaagccgcgcctactttggagataatccgcatttacgggtacaagaactttgcggtttactctcaggcgcaaaagatcaaaccatcccttatttcatcattgatgaagcgaaaaaatatattcaagaatcattagatgaaggcaagccgttctttgcatggataaacttctgggggccgcatacgccttgtattgtgccagaaccttattattccatgtatagaaaagaagatgtggtgcttgataaaagtttctttacaccgttagagggcaaaccagaccatttccgcacaatttcaaaaatgtggggaatgtgggaggcgagcgaagatcattggaaagaagtcatcacaaaattctggggttatattaccttaattgaagatgataaccttgtttatcttcacgatttaacttcaacagtgttcgatttagccaatcaaaaagtgccagaaagttttgaagggcagagcgttcttccgattatgcgccaacaccaagataaccaacgaaaaggtgtacttggtcagctcgcagggcattttgtgtattttgaacagcgtatgtggcgtcgtaaagattacaaactcgtatttaatgcgactgatgtttgcgaactttacaacatccgtaacgatccagaagaaatgcacaatttgttttatgatcctcaatataacagaatcaaaaaagagatgttggaagaaatgcgtgcagagatgaaacgtctgaatgacccactggaaaattgggtttatcgaattattgacgaaatttaatcaaagtcgtagattaagggcgtatctgatacgccctttgttatctctgcaccttatttatcttttaaaataggaataaacatgaaaacaacattactaaaaacactgacaccagagcttcatcttgttcaacataacgacattccagttccttcacttaaaacatgcggttggaacaccaaaaatttcccctgcaaggggcacagcttatcagttggaancccccaaaatgcgaagcaagatgtattatggctaagtgaagtagagccattcaaaaatggcaatgctattcgtggtggtgtaccgatttgttatccttggtttggtggcgtaaaacaacctgcgcacggtacagctcgtattcgtttatggcagttgagtcattactatatttcagtgcataaagtgcggttagaatttgagttgttttctgatttaaatattatcgaagctaaagtctcaatggtatttacagataaatgtcatttaacttttacccattatggcgaagaatcagcccaagcagcattacatacctattttaatattggggatattaatcaagtggaagtacaaggtttacctgaaacttgttttaatagcttaaaccaacaacaagaaaatgttccgtcaccgcgtcacatttctgaaaatgttgattgcatttattctgcagaaaacatgcagaatcaaatcctagataaaagtttcaatcgtacaattgcactgcatcatcataatgcaagccaatttgttctttggaatccttggcacaaaaagacgagtggaatgagtgaaactggctatcaaaagatgttgtgcttagaaactgcacgtatccatcacttgcttgaatttggcgaaagtttaagcgtagaaatttcgcttaaaggctaaattttgttgcataagtggtgtgaatactatagaattcgcgagactttgctcgttccttgcgggcaacaaatttgaaatcttttatttttagcgaaaagatttttactattaaccaatagaaggaatacgattattaaaaccgtaaaaaaagcaccggcagtaaatcgcccaaaccgtatcaatgaagagattcgtgtaaaagaagttcgtttaattgaccaaaatggtgaacaagcngggattgtttctattcaacaagccctagaaatggcagagcaagcagagcttgatcttgttgaaattagcccaaatgcagagccgccggtttgtcgcattatgaactacggtaaattcctttacgaaaaaagtaaaaccgctaaagaacaaaagaaaaaacaaaaagttgtccaagttaaggaaattaaattccgcccaggcacagacgaaggtgactatcaagttaaattacgtagcttaatccgtttcttagaagacggtgacaaagcgaaaattaccgtgcgtttccgcggtcgtgaaatggctcatcaagacatcggtttagatgtgttagagcgcgtaaaaaatgatttagctgaaatttcagtggttgaatctgcaccaggtaaattagaaggccgtcasstgtaatggtgttagcaccgaagaaaaaataagaattttgctgagatttttcagcaaatctttttgtttaagtttgacttaaatgaaaagacaactgcatgttgggcacactacgcagcctaactgcttttgaaaaggcgatttaatttgccttatgatggaaatgatcagtgcttccaagtaactttataagttcgcctgattatgttgttttaaacgaaaaatgcggagttattttaacaatgcctaaaatcaaaacagtacgcggcgcagcgaagcgcttcaaaaaaactgcttctggtggtttcaagcgtaaacaatctcacttacgtcatatttttgactaaaaaaacactaaacgtaaacgtcatttacgtcataaatcwatggttgcgaaagcagaccaagttttagtagtagcttgcttaccatacgcataagccgttatttaagcaaaacgtacgattagttcattnttagaaaaatattacataggagattaaataatggctcgtgtaaaacgtggtgttattgcaagagcacgccataagaaagttcttaaggctgctaaaggttattatggtgcacgttcacgcgtgtatcgcgttgctttccaagcggtgatcaaagctggtcaatacgcataccgtgaccgtcgtcagcgtaaacgtcaattccgtcaattatggattgcacgtatcaacgctgcagcgcgtcaaaatggtttatcttatwgcaaatttatcaacggcttgaaaaaagcatctgttgaaatcgaccgtaagattcttgctgatatcgctgtwttcgacaaagtagcgttcgctgcattagttgaaaaagcaaaatctgcactttaattttttaaagtttagataaagaagaattaggacgctgaaaagcgtcctttttttgcacttatgactttaaattttgtaaaataatgccattagttctcatctgttaaaatctatggccgaaacaatcccactgaatcctatcacgttgcctttaaatcaaattagcttaatcgaagcatctgctggtacggggaaaacctacactatcggttctttatatctccgacttttattaaaggctggagaaaataacttttctcgtccgttaaatgtggaagaaattctggtggtaacatttacggaaatggcaacagaagaactcaagaaaaaaattcgtgagcgtataacagatgcgattaataaactcactgcctttgctaaaacccaagataaatccgcatttaaaaatgatgaatttcttaccgcactttgtgataatttgaacatttttgaggcaattcatcgcttaaagttagctgagcaaaatatggatttggcggcgatttataccattcacggtttttgtcgccgtatgttgatgcaatatgctttccattcaggcattcacttcaatttagaattaataaaagatcaatctgatttgttagttcgttttgctaatgaattttggcgagaacatttttatccgttagattttgaatctgcgaattttatcgcgacagaattagtatcaccagcaaatgtgttgtctttgttgaaagcggatttaggtaaagatttgcaggtggagattgaaaataaacaggcgttatctgtaccaatacaaatctttttaccgcaatatcttggtggttatcaaaaggcgttgaatgaattaaaggcattttggttagaaagtgcggatgaaatttcagcgattattacaaatgagctggttaaagattatccaaaagatcagttgaaatcgttaaatcgtaaaaagtaccaagtaaagcgtttaggggattggattaataaaattaatcaatggtcaaataatcctagagattatcaaattaataccacattgaaagactatttcctacaatcatctattgagaaaaattgcgaagaatcaacggataaaaataaagataaaaaacccgcaacgcctttttattccccgatttttgcagatcttgaaaagcgcgttaatgccttaatgacaccagatttactaagcaaactcactctttatcattatcgccaaggtctacaacaaaaacttttagactataaactaaatcatcaagaaaaatcctttgatgatttattgcgtttgctttgtgaagccttgcaagatgcgcaaggagatgaattagcggaaatgattcgcttccaatatccttttgcgatgattgatgaatttcaggatacagattcacaacaatacgctattttttcaaaaatttatcgtgataatcccgaaaaaaatactggttttattatgattggtgatccgaagcaggcgatttatcgtttccgtggtgcagatatttttacttatctaaaagcatcggacgaagcccaatctcgctttgaactcactaaaaattatcgttcagagaagcatttggttgatggcgtaaatgctttattcgattttcctcaatcgccatttatttatcaaaatattaaatttactgctgttgattctcgtgatgatcatcttcgattttatttaaatggtaaagttgaaccagcttatcgtttttatctaactgaaagtgacaaagtgaataaaactgaaatggcaaaaatatgtgctatttctattcaacattggctaaaaagtgcggcagaaaatcaggcagtttttcaaaatgaagatacctataaaaccttacaagcggcgaatattgccgtattggtgcgtgataaaaatgaagcggctttagtaaaaaatgaattgcaaaaattggggatcgcgtcggtttatctttctgatcaaaatagcgtatttgatagcaatgttgcgaaagaattagcttgggtacttaaagcctgtttgaatgtggctgaacgcccaattttgaacgcaattgcgaccgcactttttggcttaaatgcagcggatattcatcaaattcagcaaaatgaggcagactggcaacgttgggctgatagctttgctcaataccaacaaacttggcaacgccaaggaatattggcaatgttacatcaaattttattggagcaaggcatttcagaacgcttattaagccaagccacgggcgagcgagatttaacggatttcctacatttggcagaaattttacaacaagctgccacgctacacgaaagtgaagcggcattgctcagttggtttgaaaaacaaattcaaggcgaagctcgtcaagaggctcaaattcgtttagaaagcgaacgccaattggtgaaaattgtgacaatccataaatctaaaggcttagaatatgatttagtttggctaccatttttagctgcgccgagcaaagatccaagtaaaaaatacatcaatatttattattctaaagaacgagatgaaaccttatgggatatagaaaatcgcaatttaaacgctctttgtgaagaaacttttgcggaagagttacgtttactttatgtggctttaacgcgtgccaaatatcaaatggcattcgctttgcctgcgcaatttgataaaaaatggaatgccttgcattatgtactaagccaaggtgaaataggcaaggaaataaatttgtcggattctaaagataccgaaacattgttgcaaacctttaaagaaaaaatgcaagataatgtggaaatctgtactaagccaaatctagaggctttgccgaccttatcaattaatacaaaaaatgatgattttaaagcctcagaatttacgggcaatattgagcaagattggcgaataaccagttttacttcaattgaacaagcacatcgccgacaaaattatttcactgaaagtgcgggtaaaaaacacgctgtttttgatgacgcaaaagattacgatagtcaaaatgctattgaaatttccaccgcacttttaaacgaaaatgaatcaaatattttagatttaccacgaggtaaacaagtcgggactgcattgcatcgccattttgaaaattgctatttttctgacttggcaaatacagaagaaattgacaaattaagacaatccttacagttagatgaaacttttacagagtcgctacaaaattggctacaacagatttcacatacaccactttctaatgaaataggaatagcattagctgatttagcaaataaagattgcattaaagaaatgccattttatctggctattcgggaacattttgatgttgaagcgtttaatcacacgttgaaagcgcatcatcatttgccaagcgagtcacttcaatttgaacaaattcagggcatggtgcgaggttcgattgacttagttttccgccataatggaaaatattatcttgttgattataaatctaatttcttaggttcaacccttgctgattacaatcaagaggcattgaaaaaagaaatgttacacagtcactatgattggcaatatttaatttatacgctggcattacatcgttatttacaaagtgttgtgcctcattacgattatgcacgagatttcggcggggtattttatcttttcttacgtggaatgaacggtgagccacaatctggcgtattttacgatcgtccaagcgttgaattaatcacagaattagacggggtgttttaatgttatctgtattacacaaacttaaagagctgcgcattctttctcaaggtgattattattttgctaagttgatagctgataaacaatgtcatacggattatgcggaaccagtcaaaaatttagccatattattagccgcactttgtagttggcgttatacgcagggaaatacttgcagccaattagatcgctatttagaacataatttatttggcttggcttatcgcactacagaagaagattatttagctgaaattcatgaaaagattggttatttacccgttgaagattggcaaaatgcgttgtgcgggcatatggcatttacgcaagatcccgtcaatcaaattgcaccaatggcatttcaatttggcgcgttgtatttctatcgcgcttggcaagatgaatatcgcatcgtgcaatatataaaaaataccttaaaaaaataccgcactttagccttttcttatgatgaaattcatcaaaaattagagaaatatttccctgaaaaacaggaaaaaacagattggcaaaaagtggcagtggcgacagcgattaaaagtccattttcgattattacaggcggcccaggaacaggaaaaaccacgacagttacgcgtttattgctcgttctacaagaattatttgattgtaaattacacatcaaattggttgcgccgactggcaaggctgcatctcgtttggaagagtcgattaaaaatgcgttaggttttatgcaagaaaaaatgaatgtatcccattcacttttcaatgcgattccacaaaaagccagcaccttgcatagtttactgggcgtgaatgcctttaatgattacacacgatataacagccataaccctttgcagttggatgtattagttgttgatgaaacatcaatgattgatttaccaatgatggcaaaacttatcaatgcattaaagcccgaaactcgattaattttattaggcgatcaggcgcaattagcctctgttgaggcgggggctgtattgggggaattggctcaatttgttactcaaccttatagtcatgaacaagccgcatacttactagcaacaacaggctacaaagtagaaggttccgattgttcaaatccaatacgtgattgcttatgccatctaacagaaagtcgccgttttgataaagattcaggcattggcaagttgtccgaattcattcaaaaaggcaaagcagacgatagccttgagttatttgaccattatccgcaagaattgcactttaattccttaaatgatgaaggcgatgcggtcaatcaagtggtaaaaagtgcggtggaaaattaccgcactttcttaaaaatgttggacgatttacgtaaacaaaaaattgatcctaacgctaaaaatgaacaaggcatttcctatgccgaagctattcaagtgcaatttaattctgtgagatttttaaccgcacttcgtaataacaatttaggtgtcgaaaatctcaataaagaaattgcgttagcgttgcgagagcaaaaattgctttggttccgtaatgaacaagattggtatatcggcaagccaattatgattactgaaaacgatcataacgttcgcctttataacggcgatattggactatgcttggcaaatggcaaagtatggtttggcaatcgagaagtgctgacaaaccgaattccagcgcacgaacccgcttttatgatgacgattcataaatctcaaggttcagaatttaaacataccgtcatggtgcttccaacagaagtaaatccagtattgtcgcgagaattagttttcacgggtgtcactcgtgcaaaaaaagaacttactgtatttgctgatgaaaaaatatggaaaacagcaattcgccagaccgtcaaacgccagagcggattgggaaaattattggaagatttaaattagtaaaaggcggtaaatttggaagataaatcaatcagataatctccatttaaaataacttttggggaagattattttaataaattcttcaaactggttttcattgctgccatttgattttcaaattgtgccttgctttctctttcgtcaatcatataggtaattgtttccgaaagcgtcatcttcatttttcgagaatatttagaaagacgtagccaaacagcatattccaaatcaatggattttttcttggtatgttgtttttctccattaaaaaagcgtttacggcgggcacgaatggcttgatcaagcttaattggtaaggctggagaaagatgatttttaatccattcttcaattttttcaggataattttgggattctaataattcttgggctttagcttcttgcaaactacgttcttcgtagcgagtaatattttccccttcgcgatgtttacgaattaggtaaatccatttccaatttgcttcttgattttcgagtttttggtatttcattttttatcattgagtgacgtggtaactgcattaatatacgtgtttttatgccgattttctagtggattttcacaaggctattaaatatgcgataatgtggtcaatttttctagaaagagaccagccgtgagttcattattttctcaacaacaagctattgagcaatctttaaattggcaggcattacaacctgatttggtaattcaagattttcctttagaaccagtgaatttctgggcgttacaaccgaatgctacacagggtatcgatttatttttacgtcatccgacacgttccttgctaatgatgaaagtgggcgaacctgttgaatatgcggagttattacaaaattttatatcgcaaaatcatcataaagtgcggtcaatttttggtgtaaattatgtgatagagcagggcgactctttttcttttcctcatgtttatactgagccagcaaaatctttagatgataattttgctagtcaaggggaggcgttaagcgcattgtattgcgatcaattccagcttttcggtagttttcggattcatccacgttcacaagatattcaattagtgccgggattggtgcataaggctaatggtggcgttttgattttaagtgcggcaacattgttatctcaatttgatttatgggggcgattaaaacaaattctgcaaacccagacttttgactggtattcagcccatccatttaaaaatttaccttgtgatataccaagctatgcgctgaacttaaaagtgattgtacttggtaatcgtactgaattagccactttggctgagttagaagaaaatctttattctttcgccgattatgctgaaattgaaagttatatttctgtagctgaagtggaggaacaaaaaacttgggcgggttatgtacaacaaatggctcaagagcaaaatattgagctagattttcttgctttaaataaactctatcaattattagttcgtgaaagtgaaaatcgctttttaattaatgcatctcctctcaaattaaaagaaatattacaggatgcctcaacttttactgaaaaaacagcattaagtgcggtggattttgagggtatttttcaacaaaaattagcgcaatatggtttcttaaaagaacaaacttatgccgatattttaaacgagcaagtttatgtcgaaacgcaaggcgaaattgttggacaaattaatgggctttcggtaattgaatatcctggtacgccagtatgtttcggcgaaccttcgcgtattagttgtattgtgcaatttggcgatggggaagtgattgatgttgaaagaaaaaatgaactagcgggaaatattcacggtaaaggaatgatgattgctcaggcttgtctttccaatatcttagatttgccctcgcaattgccattttctgcatcattggtgtttgaacagtcttatggagaaattgatggcgatagtgcatctttggcgattttttgtgtgttagtaagtgctttagccgatttgcctttgcctcaacatatcgcaattacaggatcaattgatcaatttggacttgttcattctgttggtggtgtaaatgataaaattgaaggcttttttactatttgccaacgtcgtggtttgactggaaaacaaggtgtaatcattccaatgacaacaatccagcaactgagtttatctgatgacgtgaaaagtgcggtaaaaaatggcgagttttttatttatcctgtggaagatatttatcaggcttgtgaattgttatttgggcgtgatttgttagatgaaaacaaagattatacagaaaaaactgagtctttatctcgtcttattcaacgtcgtattgagggacgtgccgattctgaacgaaaaagtttttggcattttttccgctcctaatagagaaaagcgagcattttttcgcttttctttttttctataatttctaagagtgactgctccgacaagttttgcgaacaagtgttagctatttacagtttactgcgttccttttaaaataaatatatcagttataaactggatttatcatatataaaggaatctgaaatgcaaaacgcttgtacacttaataaaaaaagtagttattcttatgatgatttgctcgcgtcaggtcgcggcgaattatttggtaaagaaggcccgcaattacccgcgccaacaatgttgatgatggatcgtattattgaaatgaatgaagaaacaggtgctttcggtaaaggatatattgaagccgaacttgatattaaacctgaattgccgttctttggttgtcatttcattggcgatccagtaatgccaggttgtttaggattggatgcgatgtggcagcttgttgggttttatttaggctggattggtggcaaaggaaaagggcgagcattaggggttggagaagttaaattcacaggacaaattttgccaacagctaaaaaagtggtgtaccgaatccatatgaaacgagttattaatcgtaaactagttatgggaatggctgatggtgaagttgaagtagatggtcgtgttatttataccgcgacagatttaaaagtgggactattccaagatacctcaacattttaatttttctttattaantcatacaaaagtgcggtgaaagtttttcctagattttcaccgnacctttacttattaaattgtaataaatttttaaaatatctataatattcttgttattttttaattttattagtggtaaataaagtttattttaaagtttttaataaacgttattatagaaaatattaaattaatttctatttaaattataaataatatactaaagtagtgggaatatgatggtaaatgatgattttcaagaatatgtgaagcaactggtaacaaaacatcgagatgaacgaatttatccttttcaatatgaaggaaaaaaatattggttgaagcaacctgaaaaattgaaaggtatttggctattattaaaaccccatcctaaaaaatcttttaaaaatgaattatatactttattgaagcttgctgaacaaaatgcgccagtgccaaaagtctcttattatagtgatcatttttttgttttagagaatgtgggacttaccgtatcacaatggctatgtaataaaaatatagatgaacaacagaaatttttaattatttatgatgcttgtctcgctttgattgatttgcatgctaaaaatttggtgcatggtcgtcctgctattcgagatattacttgggataaagggaaagttacttttcttgattttgaatctcgttcaaatagccgaaatcaaaattgggtagttattcgggatatgttatttttctttgatagtttatgtcgagaagaagatatttcggacacttttattcaaaaagtagcgttgtattatcaaacacattgtgaagcgaaaaattggcaaaatatgatcgtatttttgcaacgttttagctgggtttattatcttttattgccttttaaacctattgcaaagacagatttaatttcgatttatcgcttatttgaaattttcttgataaagaaaaaatgatgaagaaaatattttttatttttgcattatcaggcatattagctgcttgtactgtgggtggtggtgttagtgctggtggtggaagtaatggtgtaggattaggtgtggggattggatctggtattcgcttctaataatgaaaagtgcggtaactttaatctttatcttgcatttgaacttattcatcgttagaatgcgatttccttgtcatcgctgagttagagatcggcgaatgatgtattaacaacactaccttttaggagtaaaaaatgtctctaagtactgaaaaaaaagcagcaatcgttgctgaatttggtcgtgatgcgaaagataccggttcttctgaagttcaaatcgcattattaactgcacaaatcaaccacttacaaactcactttgcagagcacaaaaaagaccaccatggtcgtcgtggtttattacgtatggtttctcgtcgtcgtaaacttttagactacttaaaacgtactgatcttgctttataccaaagcactatcgctcgtttaggtttacgtcgctaattttttattacgatagtaaaaaatcaagccctcgaatattgagggcttttttatggggctgtactagataactagaccaaactccccttaactaattgttttaaaatggaaatttgagattttatttcgctattgttaaaacgccattcacattcttttaaatacagctcaaaatgctctttgggaatgccattaaacttctgtaaatggcgttttgcgtgattccaaaaattcccaattccgtttatgtagttgtgattttcagcaaaatgcgtgctgtgattgatgcgaaaatggctaaattcactgacatcaagcacatcataactacgaaaggtatccgtgtacacaatgctatcaggcttaactttctctcggataattggcaataatgttgctgattgcacattaggaacaacgacggtataaaccttgcatttcatttgagaagcccgaatactgcgactttccctgcaacactgcgaccacgtttgccttttcgagtactgccgaaatagctttcatcggcttcaattttgccttcaaacatttccaaatgtgggcttgtttgataaatgagtaagcgtaatcgatgaaagtaatagtggctgtatttttgtttacattaaccaatttactggctgttcttgctgtgacacctgcgacaaacagttcaatgagtttattttgtttatgctgacttaagcgactttttctcattggtttattctaacctaaatgggatttttagttgttatctactacagcaccttaatatttatagagttcgttatataaattacgctcgaattgtactaatggggcacgttttgttttgctttctaaatcgccagttgagtagccattaataaattgtacaaatgccactttttcccctcgcgcatttgtcataaagccagctaggttataaacgcctttcaaagaaccagttttagcaatcacgtttttcactaatggcgggctaattaatccacctcgcccactgatcgtgccatctacacctgcgatggggaaagtttccattaaatgtagtttatcttcgtttttggcgatgtattctaaaacggatagcatcgttttaggtgccacaagattatggcgagatagacccgaaccatcggctaaaatgctattaccaaaacgaattccttgtttttgcaatatggatttaaccgctaatgtgcctaattgaaaggaggcggggcgtttatagtaattgaatgccaccgctcggaataatgaatcggcaatttggttatcggattttttcatcatttttttcaataaatctggtaatggttttgataaatgtttcgctaatagctgaccttgttgtggtttttggggtaacaagactttgccattgaactcaatacctaattgtcttaattgacgttgaataatctcagcagcataagcatccgtattttgcacggcaaaacttaagccaaaaggtttatattgacgggctaaacatccttttacttgatagcgattattgtcgtgtacaacaacatcgagctgacaataaggcgcttcattgctatccgctacataaacttgtccgaacacttgaataggaaattgtgcaggcacattaatttttactatttcacctggatttttattcgcatctagttccgcataaaaacagttgttatcaatatttgcagctgctggtggagagttgaaacacattgtgagatcgttccaaatccaacctaatcctcggtcgtgactagaaaaaacagaggtatctaatactaaatcgccattaatttttttgatgccttgtttttttaattcggcaagtaagctataaagctgacctcttgtgagatcaggatcgcctgtgaaacgcacgattaagttgccatctaaattcccattttgaattttcccattactcaaaagtgcggtctcaaattggaattgatcgtctaatgcaagtttagcggcaacggctgtaaaaactttttgtgtgcttgcagaaagcataaaggttgagccattataatcagcaataatttggttttgatttatatttttggcgatgaaacctacgttagagccttcaggcagtttttgtgttaaatctgaaacattaatattggcgaaggttggaaggctaaaactcactgaaagtaaaaaggaaccaagtgcggtggaaattgaagataattttttcatattaggtttgttatggttgctatttttttttagacgaacaataataagccccgaatgaaattgagtaaattattttctcatttcaagtttatttttgataatactgcagtaagattttagaattttactgtggtttttgttttatttagtaaaaggaaaaacaatgcaacaaattccaatgactgtgcgtggcgcagaacaattacgagaagaattggatttcttaaaaaatgtacgtcgtccagaaattattaaagccatagcagaagcccgcgagcacggagatttaaaagaaaatgcagaatatcacgcagcgcgtgagcaacaaggtttttgtgaaggtcgtattcaagagattgaaggtaaacttggtaatgctcaaattattgatgtctcaaaaatgccaaataatggtaaagtgatttttggtgcaacagttgtgcttgtaaatacaaatacagacgaagaagtcacttatcgcattgtaggcgatgatgaggctgatattaaatctggtttaatttcggttaattcaccaattgcgcgaggcttaattggtaaagaattagatgataccgttaatattacaacgcctggtggtgtcgttgaatttgatattattgaagtgaattatatttaaataaaaaagtgcggttaaaaatgaccgcacttttgttgttatttgcgtggaagctgaatttttgcttcttcgcttgggcgataaagtaccaaaatatgcccgatagtttgtacttgtgctgctttagtttcacgcacaatcgcattgataataagttgttttgtttcacgatctgcaccagcaacttttactttaatgagttcgtgatgattaagtgcattttcaatttcagcaagtacacttcggttaagccatttccaccaagcataacgactgggttaagatggtgcgcaagaccttttaaaaattgtttttgtttggttgataaggttgtcataaggattcctaataaaaaagagcggttgattttctcaatgttttttactgatttcaattagcttcggcttgaatttgacagattgtacccaaatataggcgaaacgactacaaaaaatagaagattatgggaaagaaaaaacgttcagcgagttcttctcgttggctaaatgaacattttagtgatcaatttgtgcaaaaagcacataagcaaaagttgcgatcacgcgcttattttaagattgatgaaattcagcaaacggataaattatttaaacagggaatgaccgtggtcgatctcggtgccgcaccaggcggttggtcacaatacgtagtaagccaaattggtggcaaaggtcgagtgattgcttgtgatattttagaaatggatcccattgtaggcgttgattttctacaaggtgatttccgtgatgaaaatgttttgaatgctttattagcacgcgtaggcgaagataaagttgatgttgtgatgtctgatatggcaccaaattttagtggaatgccatcagtggatattccacgcgcaatgtatttggtcgagcttgctttagatatgtgtaaacaagtcttggcaagcaaaggaagttttgttgttaaagtctttcaaggggaaggctttgatgaatatttaagagaaattcgttctttatttgatgtggtaaaagtgcgtaagcctgaagcatcacgtggacgatctcgtgaagtatatattgtggcaacaggctataaaggataattgctttgatagcttttcattgctaatgatgtgtagtatcttgtgacgaaattttttaacttaggaaaggtaggttagactttgaacgatatggtcaaaaatctagtgctttgggtggtagtggcagtcattatgatgacagcataccaaagtttcaattcatcttcgggtagaaaattctactgattatacaacctttgtttacgatgtaagcaacggacaagtgacagcggcacgttttgatgccaatgaaattacggtaacgaaaaccgatggttctaaatattcaaccgtaatgccaccacttgaagacaaaaaattgcttgatgatttattaagcaaaaaagtcaaagtggaaggcacgccatttgaaagacgtggttttttatcccaaattttaatttcttggttcccaatgttattccttgttggtgtatgggtattctttatgcgtcaaatgcaaggcggtggcggcaaagcgatgagctttggtaaaagccgagccaaaatgttgaatcaagatcagattaaggtgacttttgcggatgtggctggttgcgatgaagcaaaagaagaagtgggggaaatcgttgatttcttgcgtgatccgaataaattccaaaatttgggcggtaaaattccaaaaggtattttgatggtagggcctccaggtactggtaaaactttacttgctcgtgcgattgcgggagaggcaaaagttccattcttcactatttctggctctgatttcgtagaaatgtttgtaggtgttggcgcatcacgtgtacgtgatatgtttgaacaggctaagaaaaatgcaccttgcttaatcttcattgatgaaatcgatgcagtgggtcgccaacgtggtgcgggcttaggtggcggacacgatgagcgtgaacaaaccttaaaccaaatgctagttgaaatggatggctttagcggtaatgacggtgtaattgttattgcagcaactaaccgtccagatgtgcttgatccagctttaacccgtccaggccgttttgaccggcaagtagttgttggcttacctgatgtgaaaggtcgtgagcaaatcttaaaagtgcatatgcgtaaagtgtctgttgcgcaagatgttgatgcaatgacgttagcgcgtggtacgccgggctattctggtgcagatttagcaaatttagtcaatgaggcggctttgtttgctgctcgagtgaataaacgtacggtaaccatgcttgagtttgaaaaagcgaaagataaaatcaatatggggccagagcgtcgcactatgattatgacggataagcaaaaagaatccactgcttatcatgaagctggtcatgcgattgtggggtatttagtgcctgaacacgatcctgttcacaaagtgaccattattcctcgaggacgtgccttgggtgtgacattcttcttacctgagggcgatcaaattagtattagccaaaaacaattagaaagtaagctttctaccttgtatgcgggtcgtttagcggaagatttgatttacggcgaagaaaatatctcaacaggtgcatcaaatgatattaaagtcgcaactaatattgcgcgtaatatggtaacgcaatggggattctctgaaaagttaggtccgattctttatacggaagatgagggcgaggttttcttaggtcgttcaatggcgaaagcgaaacatatgtcagatgaaactgcgcattcgattgatgaagaagtgcgtgcaattgtaaatcgtaactatgcgagagcaagagagattttgatcgacaatatggatattcttcatgcgatgaaagatgcattagtcaaatatgaaactattgaagaagaacaaattaaacaattgatgaatcgcgaacctgtcacaccgccatcaggttggggagagccgaaaactcagcaggctgcttatgcaaattcaacaacgaatgatacaaagcccgaaagtgcggtagaaaataccgatgattttaatgtttaactcatcaaagcctttcttcggaaaggctttattttttcctaatgattttgttcttggatgtatttcgctataatcgcccaccaaaatcactctaaaaattaaccgcattttatgaaactttacgcaaataataaatgtcttgatttaagcgtgcctcaaattatggggattcttaattttacgcctgattctttttctgatagcggacagttttttagtctagataaagcactttttcaagttgaaaaaatgctagaagagggggcgacaattattgatattggtggagaatccactcgtccgaatgcggatgaagtttctgaacaagaggaattgcatcgtgttgtgccagtagtggaggcggtgcgaaaccgttttgattgctggatttctgttgattcctcaaaagctgttgtgatgcgtgaagcggcaaatgttggaatggatttgattaatgatattcgtgctttgcaagagccgaatgcgttagaaacggcggtaaaactggctttacctgtttgtattatgcatatgcaagggcaacctcgcacgatgcaagcaaatccttattatgaaaatgtcgtgcaagatgtattggcttttttacaaaaacgtactaatgaatgcctttctgctggcattaaaaaagaaaatttaatttgggatatgggctttggctttggcaaatctgtacagcataattatcaattattacaaaatctgaatgaattttgtcagataggttatcccgtattagcagggttatctcgcaaatcaatgattggcgcagtgcttgataaacctgttgatcaaagaataattggcagtgcggcaggtgcgcttattgcagtgcaaaaaggtgcaaaaattttacgcgtacatgatgttgctgcaacatcagatatgctcaaagtttggcaggcaacagcaaatgcctgatggttttataacgataaaaaattaaaggaattttattatggcaaatcgtaaatattttggaacagatggtgtacgtggaaaagtaggtgcttacccaattacaccagatttcgcattaaaattaggttgggctgcgggaaaagtgttggcttctcaaggttcgaaaatggttttaattggtaaagacacccgaatttctggatacatgttggaatcagcccttgaagcaggtttggctgctgcggggttatctgctgcatttaccggccctatgccgacacctgcaattgcttatttaaccagaactttccgagctgaagcaggtatcgtgatctcagcctctcataatccttattatgataatgggattaaattcttttcagcaaaaggcactaaattacctgatgaaattgaagaagctattgaagcaatgttagagcaaccgatggattgtgtggaatctgctgaattaggtaaagccagccgtattaatgatgcagcaggacgctacattgagttttgtaaaggtacattccccgctcatttaggcttggaaggttataagatcgtggtagattgtgcaaatggtgcaacttaccatattgcccctaatgtactaagagaacttggtgcggaagttattgaaattggtacgganccaaatggtttaaacattaatgaaaaatgtggcgcaactgatgtgactgcattgcaagctaaagttgttgaaacgaaagctgatgttggtttggcttatgatggcgatggtgaccgcattatgatggtggatcatttaggaaataaagtcgatggcgaccaaattctctttattattgcgcgtgaagcattgcgctcaggtcaattaaaaggcggtgtcgttggcaccttaatgagtaatatgagcttagagattgcgttgaaaatgcttggtgttcccttcttacgtgcaaacgtgggagaccgttatgtattggaaaaaatggttgaaaatgattggacgcttgggggggagaattctggacatattatcattgcggataagaatacaacgggtgatggcattgttgcgtcattggctgtattggcggcgatggcacagcataaattatcattaaatgaattagcaagtgcggttaaattattccctcaagtgttaatcaatgtacgttttgcgggtggggaaaatccacttgaaagtgatgctgtaaaatctgttgccgcagaggttgaaaaacgtttagaaggtaaaggtcgtattttattgcgtaaatcgggtacggaaccacttattcgcgttatggtggaatgccaagatgctgaacttgcacaacaatgtgcagaagaaattgcagaagccgtgaaaaaaattaattaatttttgaccgcacttagtaaagtgcggtttatttttataaagtttttaggaaagcnaaatgaacatttttattatgcgtcacggcgaagcggaagtaatggctaatagtgataaagctcgccatttaactgtttatggttctaaacaggcttttttacaagggcagtggttaaaacagcatttaagcacgctagtaattaattcactagaccgtattttagtgagcccttatgtcagagctcaagaaacctttcatcaagttaatcaagcgtttgatttggagttagaaaataaatttgaaatttgggaggggattacgccttatggccatgcgcattcagtcattgattatttagaagtgctaaaagacgagggcgttaaatctgtattaattgtttcccatttgcccttagtgggagaaattgttgctgaactgtatggaaaacgaaatccaatatcattttatcctgcaactattgctcaattattatgggatggtaataaatcagaaatattgatgcatcaagcatctcctgtaatttatttaaaataaactattctttttttttacaaaaaataaaatttttattggttttttataatctattnaaaatcaatatcttagatgtttttttataaagtaatctttttaaagaaaggtaaagttttactattactgtttttctttttatgaaaattcccgtaaactaaactgcatcaaagtaatagggctttgtaacaatcaaattattctatggagaaaataatgaaaaaattaacattagcattggttttaggttcagctttagtcgtgacaggttgttttgataagcaagaagcaaaacaaaaagttgaggatacgaagcaaactgtagcatcagtcgcatcagaaacaaaagatgctgcagctaatacaatgactgaagtaaaggaaaaagcacagcagctttctacagacgtgaaaaataaagtagcagagaaagtggaagatgcgaaagaagtaattaaatcagcaacagaagcagcgtcagaaaaagtaggcgaaatgaaagaagcagcatcagaaaaagcaagtgaaatgaaagaggcggtttcagaaaaagcaactcaagcagtagatgcagtgaaagaagcgacaaaataataggtttaatttaaataacaaaatccctgttaaagaaatttaacagggatttttcatagattaatccaatttgatttttacaaataatatcccgccattgagctatataccgcattttcactttgcagcacttgatattttgcattcaaaatcgcaagttgtgatgatttttccgtattggctgcaactaaccattcgcgcaattcggatacgcccgcattatagcggtttcgataatattgtgtgatacgctgattgtaactatgggtttgctgtaaattacttaatgtactttgcgcttgggtaaatgcgaaatagttggtatccacattattgagagcggtggtaatacgttgttcgtaatttaaacgagctgtttcatagtcagcttcagaaattttaacgttccattttacggtgttccaatttaagaacggtaggctaattcctactgtgccagcagccacagggttatgtaacgccgtaccaaccgtgcttgctgttgaagaaaggcttgcacctaaattaacctctgggaaccaacttttttgagttgctttggcatttttgaatgcactgcttaaacggaattgtgctgcttttacatcaggacgatttgcaattacagacacaggcacgtttaagtttacgcctgctgttttcacattcataatatgtgggaacgtgatatttaatgcttcatttggttttaggttgagaagattacgcagtgtttgttctgctgttttgcgttgggtttcaaaatttaatttgttattacgtgccgttaatatggcttgttgtgcttgatccgttccccagtctggctgattggtaatgaggcagttagatttcaataaatggctgactaatttttcttcgacaatttcattcgatacgcaatctttcagccaattagcgttaaattcgtagctagtaatttcaatatcttgttcatcaatgcaatcgccttgtaaatgattaattttttgagcatcataaactgccactggatttaaccgcacttttacatcgccttgcgcacattcgcttaaatcgcgttgcatagtttgttgaacggcattgaagtcggtaaatttgctttggttgaagctatttaaataaagtttaaaactttttgactcaatcaaattttggctttgataatccagataaatatctgcgatagccacttgtggcaagcctttttcgttgagccacgagatttcataagccgtccaaatatctgcaccgatagtaaatggttggttttgagtaatgcctaatccatcacgatttaacgcacgtggcacaggctgtaataaagtgcggtcatattgagaggcatattccgttttttgaccgagttttaaggattttaagctgttgtcttggtaattcatttatttttcctttatatgttaaacaataattttgccttcccttgcttgcgggggaaggtggcgcgaagcgtcggaagggggctaagactttatcattccaacagagagttgaggcatggacttaaattacaaaaaattccacgatagattcgaaactaatcgacaggtatcgcatttaaaatgaaaggtatcaaaaatcgcgtcttttaacgcccaatttgcaccacaagaagggcagcaacgggatttttcagattctaaagattgcccacctacacgatataaataatagtaagtcggtatgccagtttctttttctatttcttgagctaaatatcgtccgtgttttgaaagcgtactttgatgatcggaaatttctgccaaagattgttgttctaataccgcaccattcatttgtagttgatcgcaggcttgccaattttcttgccatttaatcagatcttggcttaggtgcggttgattttttagttgtttatacaaagggatgggtgcgaaattttctccactatgaatcggcgagcaactttgtaaatgggttgtgtaaagcacttgccaagctggcgatgtattttcagccgtttgatctgaattgaaatcatcgcccacaagttgaaaaccatcaaaaattacgccgcactttgacggattcagccaaggatatagcgtgctgttctgctgcggtaaaatcccatttttgtagccaatccagcacagcattaaagcctataaccccagcaatattgggtgtgccagcttctaaacgataaggcaattcggcaaaagtaatacgattatttgacacacgttcaaccatttttccgccaaaaaagagcggttgaagttgagaaagtgcggtcaattttcctgttaaaacgccaagtccatttgggccataaattttatgggcagaaaatgcgaggaaatcggcatctaaatcttgtaaatcaattttaatatgactaatcgcttgtgctgcatccactaaaaccaacgcatgactatgttttctaataagttgaatcaggcgtttaatcggctgttctgtgccagtgacatttgaaacaaaattcagcgcaacgagttttgttttttcagaaagggtagaaataagcacattttcatcaattagccaattatctaaaatcggtaaaactcgaatttttgcaccgcactttttcgccgtttcatgccaagtgacaaaattagcaacttgatgaaccaaccacttggatgtggaagctattgaatggttggaaaatttcttactggatttccaaggtagcattgtatttatttcccatgaccgttctgttattcgcaaaatggcaacacgcattgtggatttagatcgcggtcaattgcagtcttatctaggcaattacgatttatatttaaccacgaaagaagaaaatctacgcgttgaagccttgcagaatgaattatttgataaacgtcttgcacaggaagatgtatggattcgccaaggtatcaaggctcgccgtacaagaaatgaagggcgagtgcgagcattaaaagcgatgcgtgaggaacgccgccaacgccgtgaggtaatgggaacagccaaattacagttagatacctcaagtcgttctggcaaaattgtctttgaaatggaagatgtgagctatgaaatcgcaggaaaaaccttgttaaaagatttttcaacaacgattttacgtggagacaaaattgcgcttgttgggccaaatggctgtgggaaaaccacgttcattaaattattgctgggggaaattcagccaacatcaggcaaaatccgttgtggtactaaattagagattgcttattttgaccaataccgtgctgatttagatcctgaaaaaattgtaatggataatgtggcagatggtaaacaagatattgaaatcaatggtgtaaaacgccatgtactagggtatttgcaagagttcttgttcccaccaaaacgagcaatgaccccagttaaagccttatcggggggagaacgaaatcgtttattgctcgcaaaattgttgctcaaaccaaataatttattgattcttgacgaaccaaccaatgaccttgatgtagaaacattggagcttttagaggaaattttgactgattatcaaggcacattgttaattgtgagccatgaccgtcaatttatcgataatactgcgacagaatgttatttattcgaaggtgaagggcgtttgaataagtatgtgggtggattctttgatgcgaaacagcaacaagccaatttctgggcaagcaaagcggtggaagaacaggctaaggcgaagaaatctgaaccactaaaagaagaaagtgcggtgaaaaatgaccgcacttctaagccgaaatccgtgaaactttcttataaagaacaacgagagctagagcaacttccacaacttttggaagaattagaaactaaaatcaccacacttcaagctgaaatagccgatccagcatttttccaacaagctcacgatattaccgacgctaaattaaaagcattggcggatactgaagccgaattagaaacagcatttttacgctgggaagaattagaagaaaagaaaaatttggctgacggtaaagcttaaaaaataacgcccgaaagggcgtttttatttagaggaaatattgcacagaatcatattttaattctttgctaattgaccaattattttgctgcttttaattcttgataatattgttcatagaattgaattgcatcgccaacgtcatcttgccagtgactattttttaatatatcagctgacggataaatcgctggatcttcagtgatttcttttggtaatgcttttttcgcttcaatatttgaggttgggtaaccgatagctaaggttaatttttcagctgtttttttccctaacatgtagttaatcagcttgtgtgcgccttcagaatttttagctgttgcaggaattgcaagagtatcaacccaaagtacaggaccctcttttgggaataccatatttaaaggtgctttttcttttttagcaatacgtaccgaaccattccataattgacccacttccacttcgcctgagatgaacgagttagctgggttatcggaattgaaagaaagtacatttggacgtaatttcaataattcttcataggcttgtttgataatggctggatcttgagtatttggatcttgaccaattttcaataaagcgatgttgaatacttcacgcgcatcgtctaataattgaactttgtttgcaaattcaggtttccataagtctgcccaagaagtgaattgttcgcctttgtaagtgttggtattgaatgcgatacccggcgcacctaaaagttgcggaagagagtatttgttacctttatcataaggtttattgagccaatcaggatctaattctttaagaacaggtaatttgctgtgatcaagttcttttaacattccttcgcgtgccattttagaaacgaagtagttagaaggtgcgataacatcatagccaccagactcgccttgagttttgagtttagcgtacattgtttcgtttgattctaggcttgaaacgataactttgatgccagtttctttagtaaactcatctaaaagaccatctggtacatattctgtccaagtgtagagatacacagtgtcattagcagcagccgtagcttttgcagtttcttgcttagcatctttatcgttgcaagcggttaaagttgcagctacgaagctggcagtaattaaacctgcaaattttttcatttttgtttgttctcctgttaaagagtcgtaaaaaaccacctgccgaatgacaggcataaaaaaacgccttgattgtgcgtcaaggcgtattctattttaaattcaaaggtttgtgaaaccttttgttaattaatggttattttttcgtgtaattagctggcttaaaacgacaagagctaatgaaagcacgatcataatcgttgctaaagcattaacttcaggtgttacaccagttttcactagagagaatattctcaatggtaagatttcataacttacaccactgacaaatgatgaaaccacaacatcatctaatgaaatagtgaaacttaataaccaaccagatacaactgcaggtaatgctaaaggaaggataattttacgtaaaatagtcacttcgcttgcacctaagtctttcgccgcttctaacattctggaatcaaagccatttaagcgagagaagatagttacggtcacatacggtaaacagaaagttacgtgggcaagtagtaaagaccagaagcccaatgaaatacccacaaccataaataatgcaagtaaagatactgccattacaatatctggagacatcataacgataaatagcataccgcttactgcttgtttaccgcggaatcgatagcgataaagtgcgattgcagttaatccacctacaatagtagctagggtagccgcaaaaaatgcaatagttaccgaatgaatcgcagcttgtattaaggtgtcgttattaaataaacgctcgtaccagttccagctaaaacctttccaactcaaaccataacgatctttgttaaaggaattagtgactaaaataataattgggatatacaaataagcgtataccacaaacataaatgcattacgtagaaacgactcattattctaactccactttcctattcaatagtttattcgcgcggtagtacacgaaaatcaacaatgccattagaacagttaaaccaatactgactgcagaaccaaatggccagttacgagaaattaagaattcgctcttaattacgttaccaacaagcaagacttttgctccaccgagtaggtctgctacataaaacattcccattgctggcaataataccaataaacaacccgcgataatgcctggcatagttaatggtaaaatcactcggaagaaacgttggaatgtatttgcgcctaaatctcgtgctgcttctaataaacgattatctagtttttcaatggcagagtagagtggcaaaatcataaatggcaatagtaaataaactaagccaatgattaccgcaatttcggtattcaaaatacgaattggcgcactcaaaattcccatatcaattaacatcgtgttaagtatgcctttcacgccaagaaataccttcattccataaatacgaattaacgagtttgtccaaaatggtaaaaccacaaggaacaataagagcggtcgatatttaggatgaattttactcatcataaaagcaaatggataacctattagtaagcaaataatggtggcgatgcccgacatagacaatgaattccacacaacttgtgcataaagcggattaaacaagtttgtatagttttcaatagtaattgggaatgcataaaagttgctaccatctcgagtcagaaaacttacggcaagtaccaataagtttggaatcagcacaaagaagattagccaactgaagataatcgcaacagtaattttctggaatttattattgattatcttcatcgttgagtacaacctcccagccttcgtgccatgtgatacctacgcgttgtcctatgctatgatccatatgtggatcatcttcattaaagaattcacttacaaggacacgcattccgttatgatcaaactctaccgttgattctaatgtcattcctttataagtgcggtcaataatatgaccgataattgctttagaatgttcattttcatctaattcttcaatcacaatatcttcagggcgaaggagtacttgaagtttttgatctttttccacaggcatatccgtataaatatcacaaatacgaccttcaacatttgccagtacaacttgttctgattttcgttcaatcacagtggcttcaaatacgttaatttcgccaatgaaacgagcaacgaataagttagctggatcttcatagatttcacgtggagaaccatcctgtgcgattttacctttacgcaataatacaatacgatcagacattgtaatcgcttcttcttgatcgtgggtgacgaaaataaaggtaatgccaagctgacgttgtaacattttgagttcttgctgcatttgtttacgcaatttgtaatccaatgcagataaagactcatcaagtaacaacacttttggtttatttactacggcacgagcgatggcaatacgttgttgttgtccgccagaaagttgagttggcttacgatccgccatttcttctagctgtaccatacgcaaggcttctaaaacacgcggtttaatttcctcgtttggtactttttgcatacgcaaaccgaaagccacgttctcaaaaattgtcatatgtggaaatagcgcatagctttggaataccgtattaatatgacgtttttccgctggcacattggtgatatcttcaccatctaaaataatgctacctgaatccaattcttctaagcctgcaagtaagcgtaaaactgtggtcttaccacagcctgaggggccaagaatagtgacaaactcaccgttattaattgtaagattgaaatcattaataatggtgttagaaccataggattttttgattgaacgaagctcaataataggcttgttttgaagctgattttccactagctttggttttctccctaatttcaccaatgatttggtactgagtagaaataaaacctgcaagactgcaggggcgacatataaaaatagacgcctatgatatagtgaattgttaataatgaaaaggacttaatgccttagaaagtaaaaaactgccgttcataaaaataacgagaaatttaaccgcactttcgatgaattttacttcgttaattttataaatattgttatatatcaagatgttttctatttttctcgttaaactaaaaaagatatttttaaaaggagcgagaatatgatttctcaaatagataaaacagaacttttagaacgatttttacattatgtgtcttttcacacccaatcaaaacctaatgcgaagcattcccccagctcagtcgggcaaatgaagttagccatgcagttacaaaaagaattaatccaacttggtttggagaatgttgaagtaagtaaatatgcagtggtaacagcatttttacccgctaatgatcctaacttaacgaaaaccattggtttagttgcgcatcttgatacgtctccacaatgtagtggtaaaaatgtacgcccagaagtgatagaagaatatcgtggcggagatattgcattaggtattggcgaggaatttattagccctgtttattattcttttatgcaaaaattagtcggacaaacgcttattgttactgatggaaccactttgcttggggctgacaataaagcgggaattgcagaaattatgaccgcactttccattcttcaaaaagagaatattccccattgcaatattcgtgttgcttttacgcctgatgaagaaattggtttgggaatccattatttcccaatggaaaagttttcctgtgattgggcatataccattgatgggggagaagtaggggaattagaatacgaaaactttaatgctgcaacagcaaaagtgcggtttttcgggcgaaatattcacacaggttatgcaaaaggaaaaatgctgaatgcactgactttagcttgtgaatttcagcaagtttttcctgttgatgaagtaccagaaaaaaccgatgggaaagtgggcttttatcatttagaagatttttctggcgatattgagcaagtagagcttacctatttgattcgtgattttgacgaacagaatttcgcacaaagaaaagcttttattaaaaatcaggtggaaaaatttaatgctaaaaaaggtttgaaaaagcctatagagttagaaattcaagatagctaccaaaatatgtatgatgtggtaaaaaacgttcctcaatcaattgaacttgctgatcgtgcaatgaaagcggtgggaattaaaccaaatcataagccgattcgaggcggtacagatggagcatttttagcctctaaaggtttagcatgcccaaatatttttactggcggctataatttccatagtaaacacgagttggtttctttacaaggcatggaaaatactgtccaagtaattatcgaaatgctgaaatgtaaagatttgtaaagaaatgtaaagatttttcttgctattctttagattgctcaatataatggtggcgttttatcgagatttctttgatgaagctaaactttagagattttattcataaattcctttttaatgcccctaattatttaggggccttttttatctaattggacaagaaataataaaatagctaacaaatttaatatttcttcattttaaattattttttatcctattaatttaattctaaattctcaagaatatattttatcaactaaaaaatagttaataatcacaatttttaacgcgctacaatatttatttctatagatttatttactgatttaaaaaaacgttaaatttagtggctaaattagtttaaagagatcactgtaaataataggtataagagtttccttatattcagactgaatttgacattcctattctaaataggaaactcttacttttgaggtaatttgttagatcaaatttgatcttagacaaattaaattaatctaactttattgagttagattaattgcaggttagttttcgttagcgttgaaatttattcattaattatggcaagtttggcaagctgcttggaacatccatactaatttttcttgttctttaatatagtcactcatttgtgatgcagtaccttcatcattagcgttatttgcaaaagcaagaatttcacgttgttgatctagtaatgtttttagaccttgtaatgtgcctgataaacattcttgtgcctcacttactgcaatatcttctttaattcgagatatttttaagtattggctgtaagcattatttggtgtgtaacctaaagttaaaatacgttcagccacctcatctactctagcaactaaattagtataaatttcttcaaattttgcgtgtaatgcaaagaagtttacgcctttaatgttccagtggtagccccgtacattagtatagaaaacttggtaggttgcaagtaattcgttaagtttatcggctaattctgctgattgaactttatctagtccgattgatgtttttgacataataatttcctttttctagttgaataattgagctaatgccctccctttgatatgggtattatacgtttctataatttgaagtgaaattgttctattcaatataattgatagtcttagccttgtttgttaagaaattgtaataaatagaagctatcaaataagtgatcaagatcacagttttaatgaatatttaatcaaactatcgcggctaacaataaattttgatttaataagtacagttataattttnaatatttttcctaaggatatgttatgcaagaccttattaagcgcacctngccacaagatgatgcacttaatcaagctattgtgaatgancttcgttcacaaaattgggctggttttttaaattattcccaagtgcagcagctttgtcataattttgaacttaccacactaaaattggctatgcacttgtngccacttgctgcaagttatagtcatactgctatttctcattttaatgtgggggcaattgctattggcgaacaaggggattttnatttcggcgcgaatcaagaatttgctaattcagccattcagcaaacgattcacgcggaacaaagtgcaatttctcacgcttggttgcgtaatgaacgccgtatttcagatatggtggtcaattacacgccgtgcggacattgtcgtcaatttatgaatganttgcacggtgctgaaaaaatttcaattcatttgccgcatagccaaaataatccattacattcttatttaccggatgcgtttggaccaaaagatctcgatattgcagcgcatcttttggcggaagaaaatcatgatttagttgctgatcatcaagatgatttggttaatcaagctattttagcggcaaatcaatctcattgtccttattcaaatagcccgcacggcattgcgattttatttaaaaatagcgatgtggtgacaggacgttatgcagaaaacgccgcatttaatccaagtttgccagcgttgcaaaccgcacttaattttgcgtatttaaatgataaaaaattgagtgatattgagcgaattgtgatggctgaaaaagcattaaaattgagccataaaacgatggctgaaaccttattatccacattaacttcggtagaattagagtattattctttgtaaatatgaaacgcgagtaaaataaaaaggaaataatttccttttttatttatttgctaaaattaccgctcttttcggtgcttgataaccttcaatggttttactgtgatcatttggatctaaaaaatcaatcaggctttcattttccaaccaatcagttttacgctgttcttctaatgtagttgtcgctacatcaacacaacgtacgttggtaaagccaactttttctagccagttaattagtgtggcgacagaggggataaaataaacatttttcattttcgcatagcgatctgctggtacgagcacagtatttatatcgccatccactactaacgtttctaataccaattcgccaccttttaccaattgatttttcaactggcttaaatgatctaatggggatttacgatgatagagtacgcccattgaaaatacagtgtcaaatgccgctaatggttgcatttgctcaatacctagcgggataagatttgctcgacgatcattattaagcagtttgcgtacggcttcaaattggcaaaggaaaagctcggtaggatcaatcccgaccaccatttttgcgccttcgcctaccattctccacatatgataaccgctgccacagcccacatctaaaatagtgcgaccttgcaagggcgacaagtgaggaagaacacgatcccatttaaaatctgaacgccattcacaatctacatgaatgccgaaaagatgataaggcccttttcgccacggcattaattgttttaaatgatggataattcgttgtttttcaccttctgaaaggggagaagtgcggtcagatttcaccgcacttttgagatcgatttcatcagcatgcaaattaggtagaaaatcaacaattttgctccatttcgcataatcgccatgagtttgagtttcccattctttcaattggcacggtaaggtctctaaccagtctgataaatttgtagtagcaatttgttgataaaaagggcgaaagtcgatcattttgcttccttataagccttttctgctttatcaaaggtattaagaatatcttgttctggtttattggaaagtaatgaaataacaataattgcaaggctggcgaaagcaaagcctgggatcatttcatatactttaaaccaatcagtatcagctggaacaacttctttccaagcaaatactgtcactgcacctacaagcatacccgccattgcacccgatgatgtcattcgtttccagaaaagagagaaaagtacaacagggccaaatgcactaccaaaccccgcccaagcaaattctacaagttttaatactttgctgttttcatcttgtgcgatccagatagcaagtgcggcaataactaacaccataattctgccaagccatacgagctctttttcagatgcgttagggcgaataaaacctttatagaaatcttctgtgattgagctagaggaaattaacaattgcgcacttaatgtactcattactgctgctaaaatagcggaaagtaatatgcctgcgatccaaggattaaataaaagtttagctaattcaataaaaacctgttctggttcgcgattaactgtgcctgcaatagctggatttgcaaagaaatacggaatagcgaataagccaatgccaattgcgcctgctaagcaaagcaccatccaacccatactaatacggcgtgctttgataagtgatttgacagaatccgcagccataaagcgtgctaaaatatgcggttgcccgaaatagcctaatccccaagccgcaagacttaataaaccaagtggtgtggtagaagtaaataaatccgtgaaatctttatttacggcagcctcagcttgttctagtactgcggaaaattgagcggtatcggcgaaactcaataacacaaaaacaggggttaaaattaatgcaaaaatcattaatgtggcttgaatggtatctgtccagcttaccgcaaggaaacctccgatgaacgtgtaagcaatggttgccgctgcgccgtaccaaagtgcggtggaatattccacagaaaatatattttggaataattttgcgccagccacgacaccagaagcacaataaatagttaaaaacactwaaataatagtggcagaaacaagttttaataatttgtgtgatgaaccaaaacgattgtgaaaatattctgggagagtgagcgcattattatttaattctgtataaacacgcaaacgaccagccactaaaagccagttaaaataagccccgatagttaaaccaatagcaatccagccttcaactaagcctgataaatataccgcaccaggtaagcccattaaaagccaaccagacatatctgacgcacctgcagacattgcagtaacaaaactgcctaaacgacgtccaccgagaatgtaatctgataaattattcgtgtaataataggcgagtacgccaatcagcaacatcccgaaaatataaatagtaaaagtaataagacttgggtcgaatccaaacattatataagtccaaaatgggttaaaaatttcagaaagggtgcattttaccttatttcgggctattattctatttagactaaatatttgatgaaatttaagaaattaggaatataaaatggatgctgtcgagttattgatgaacgtaacgcctaacgaaacacgcattgcgctagtagaaacaggaatgttgcgcgaagtgcatattgaacgccaagctaaacgaggaattgtcggaaacatttataaaggtcgtgtcactcgagtgttaccaggaatgcagtcggcttttgttgatattggtttggaaaaagcggcttttttacacgctgcggacattgtatcccatacagaatgtgtagatgaaaatgaacaaaagcaatttaaagttaagagcatttcagaattagtacgagaagggcaggatattgttgtacaagtggtgaaagagccgctaggtacaaaaggtgcacgtttaacaacggatatcacattgccatcgcgtcatcttgtttttatgcctgaaaatagccacgtaggcgtttcacaacgcattgaaagcgaagaagaacgcgcccgtttaaaagcattagttgaacctttttgtgatgaactcggcggttttattattcgtaccgccacagaaggggcaagcgaagaagaattacgtcaagacgctgaatttttaaaacgcttatggcgtaaagttttagaacgtaaatctaagtacccaaccaaatcaaaaatttacggcgagccagcacttccacaacgtattttgcgcgattttatcggcacaaacttagaaaaaattcgtatcgactctaaactttgctttggcgaagtaaaagagtttaccgatgaatttatgcctgaattaagcgataaacttgttctttattctggcaatcaacctatctttgatgtgtacggggttgaaaatgcgatccaaacagccttagataaacgtgttaatctcaaatcgggcggctatttaattatcgagcaaacagaagccatgaccaccattgatattaatacaggcgcatttgtggggcatcgtaatctagaagaaaccatcttcaataccaatattgaagcaactaaagccattgcgcacgaactccaactacgtaatcttggtggcataatcattattgattttattgatatgcaaacagatgaacatcgcaatcgagtattgcaatctttatgtgatgcgctttctaaagatcgtatgaaaactaatgtgaatggctttacgcaattaggccttgtagaaatgactcgtaaaagaacccgcgaaagccttgaacacgtgctatgcgatgaatgtccaacttgtcatggacgtggtcgggtgaaaactgttgagacagtttgctacgaaattatgcgtgaaattattcgggtgtatcatttattcagtagtgaacaatttgttgtttatgcctcgccagcagtttcagaatatcttattaatgaagaatctcacggtttactgccagaagtggaaatgtttattggaaaacgagtaaaagtaaaaacagaacagttttataaccaagaacagtttgatgtggttgtaatgtaaactctatttcaataaagtgcggtaaaaatttttgagactttcaccgcactttttatttataaaaacaatatttcctttatattttatctatatgacgtaaaattaggcagctttagttgatacgcctccctccactacatcacattaaaaagcggtatcgccgtgaatgcaggcaaaaacagcaaaatttcctatcaaatgggagctggctgggtttggtaagctaaacattcaaaaaacttaccgcactttgtgcatttatacatcgccacgataatttcgtggcggttttttatggcaagtttttacaatcttttatttaaatctagtatttctatggcaagaacaggagatgaacctttattttcccttagatttgtatagaatagccgaatatttttttattttaacgagagaaaatgatgagccatacagagacatctttgggtgcagaaaatacccgcactcataattttattacccaaattattgatgaagatttagcttcgggtaaacataaaagcgttcatacccgttttccgccagagccgaatggttatttgcatattggtcacgcaaagtctatttgcttgaattttggcttggcaaaagaataccaaggtttatgtaacctacgttttgacgataccaatccagtaaaagaagacgtggaatatgtagattctatcaaagcggatgtggaatggttaggttttaaatgggagggcgaaccgcgttatgcatctgattacttcgatgcgctttatggctatgccgttgaattaattaaaaaaggtttggcttatgttgatgagctttctccagatgaaatgcgtgaatatcgtggtaccttaaccgaacctggtaaaaacagcccatatcgtgaccgcactattgaagaaaacttagcgttatttgaaaaaatgaaaaatggcgaatttgccgagggtaaagcaagtttacgtgcaaaaattgatassttcgccatttatggtcatgcgtgaaccagtaatttatcgtattaaattctctagccatcaccaaacaggtgacaaatggtgtatttacccaatgtacgatttcacgcactgtatctctgatgcgattgagcgtattacacactcaatctgtacattagaattccaagataaccgtcgtttatatgactgggtgttggaaaatatcagtattgaacgtccattaccgcatcaatatgaattctcacgtttgaatttagaaggcactttaacctctaaacgtaaattattgaaattggtaaatgatgaaatcgtggatggttggaacgatccacgtatgccaaccatttcaggtttacgccgtcgtggttatacaccagcttcgttacgtgaattttgtcgtcgtatcggtgtgactaaacaagataacgtcgtagagtattcagcacttgaagcctgcattcgtgaggatttaaatgaaaatgcaccacgcgcaatggcagtgattgatcctgttcgtgtggtaattgaaaattttgaaagcgaagcggttttaactgccccaaatcatccaaatcgtcctgaattaggggaacgtcaattgccgttcacgaaagaactttatattgatcgagctgacttccgtgaagaagcgaacaaacaatataaacgcttagtattaggcaaagaagtgcgtttgcgtaatgcttatgtgattaaagctgaacgtgtagaaaaagatgcaaatggtgaaatcaccacgatcttctgtacttacgatcctgaaactttaggtnaaaatccagcagatggacgtaaagtgaaaggtgtcattcattgggtttctgcggttaataatcatccagctgaattccgtttgtatgatcgcttatttactgtgccaaatccaggggctgaagatgatatcgaaagcgtgttaaacccaaattctttagtgataaaacaaggttttgtagagcaaagcctcgcaaatgcagaagcagagaaaggctaccaatttgaacgtgagggttatttctgtgcagatagtaaagatagccgacctgaacatttggtatttaacttaacagtaagcttaaaagaaggcttctaattttaatcaaccaagtgcggtcaaaacaaacgtgattttgaccgcactttttatttgtatcaactatgcaatccaatatgcaacttgaacccaatttctggcaaaccaaatccctgctagaaatgactgaatctgaatgggaagccttatgtgatggctgcggcaaatgctgttatcgcaaatatattcaagggcgaggtaaacgccaaaaactctattacacccgaattgcttgtaatcttttagatctggaaacaggaaagtgcggtaattattcagagcgttttaacattgaaaccgattgcaccaaactcaccaaaaagaatttacctgattttcattggctgcctgatacttgtgcctatcgtttgctttatgaaggaaaaacgctacccgaatggcatccgcttatttctggctctccccattctgtaaaaaatgcggatattttgattaaaaatggtatccacgaacgagatgtgattgattggtttgagtttattattgacgaagatcacacttttaaataaagccagttgtcatcactttcagcttagctataatccctaacaagagttatacagttgtgatgtggtgtctatgcaaatctcggattctctcaaacaaaaagcagaaaaatgcggtatcgcgctttctcactatgatattgatggacatcttattttcgcggatgaaaagacggtttcaacttttgttgagcttttgcagcctccgccaaaagcgaaaggacagtttgacgatgtactggctgcatttgaaaatgaaccgattgattatcgactcaatcgtctagatttgccaccatctgcggaatatcgttatcagctgactgatgaatctaatgctattctgttagaaaaaatactttcaaatttatccgtactttctttgcctccacttccttttggctattatcaattatctattttttccgatactgaacagtaccgaattcgtttacttatttctcctaaaacagcttttcaaccacccgtattagaaaataaaaaagtgtggggcgtaaatgtgcaactttacagtttacgctcagaacaaaactgggggattggcgattttggcgatttagcctatttgattgaacaaagtgcaaaacaaggggcggattatgtgggaattaatccattacatttgccatatcctgcggtgccaaactgggctagcccttatagttcatcctctcgtcgttggttgaatttcttatatttggacattcctgatttacccgaatttaagcgttgccgttcagtacaaaattggtttaagcgtgaggatattcaagcaaaaattgctgctttacgtgaaagtgattgcgtcgattattcttcaattttggctttaaaattaaccgcacttgagcccctgtttgatttctttcagcgtagtcaatccgttgaaattgtgacacgtcgaaaaatctttgctgagtatttaaaaaacaaaggtgaacctttgttgttacagggtttatttaatgtcttggatttgcaagaacacgccgatcatcaagcagaagaaaataccataggttggcttggctggcgtaaggaatggcaacatttaagtgcggcaaaaagaaaagctctattaaaaacacaccatgagaaaatccaattttttgcttggttgcaatggcttacagaagaacaactttccgcattacaaaatctttgtaaacagtctggcatgaagttgggtatttatggcgatttagccgtaaatagttctcgtggcagtgctgatgtatggagcgatcctgatttatattgtgtaaatgcctctattggtgcgccgcccgatccgttaggccctgtaggacaaaattggaatttgccaccttataatccaacagtgctaaaagcacgtggctttgcaccatttatcgatatgctatgtgccaatatgcaatatttcggtgtgctacgcatcgatcatgttatgggcttatttcgtttgtggtggattccaaaaggaaaaaccgcggctgacggtgcttatgtgcattatccttttgatgaattaatggcgantcttgccattgaaagtgttcgcaatgaatgtttgattatcggtgaagatctcggcactgtgcctgatgaagtgcggtggaaattaaacgagtttcaaattttctcttattttgtgttgtattttgcccaacgaaatggcgaatttccccgtatatctgattatcctcgaaatgcttatgccactattggtacacatgatgttccctcattacaaagtttttggcattgtcgtgatttagaattatttaatcaactcggtattctgaatggggaagtgctcaagcaaaaatatgatcaacgtgtcatggataaacaagccttattaaatagtttacatcgtgataattatttaccgccgcattatgagggcgatgcgctttctatggcgatgcacgattatttaaatcgaatgatccattattatttagcggaaagtaacagccgattgattggtgtgcaattagaaaatttacttagccaagaaatcagttttaatttaccgagcacctcaaatgaatacccaaactggtgcaagaaacttgctcaaccgttagcgtttatttttagcaatgaagctttaaaaacgttctttgtgcaaattaaccaagggcgaaatgtataaggagtaaatatgacaaccgcagtaacacaagcaattattgatggtttttttgatgcgagcaatggtgatccttttgctacgcttggtatgcacgaaaccgagcaaggaattgaaatccgtacgttattgccagatgccaatcgaatggtggtgattgagcgtgaaagtggtaaagaaataacggaactggattgtgtcgatgagcgtggattttttgttggtgttattccaaattgtcgtcaattttttgcttatcaattacaggttttttggggtaatgaagcacaaattatcgaagatccttatcgttttcatccaatgattgacgatttagaacaatggctactttctgaaggatctatgcttcgcccatatgaagtgcttggtgcgcattttatggaatgtgatggtgtgagcggggtgaatttccgcttgtgggcacctaatgcaagacgagtttctattgtaggtgatttcaactattgggatggtcgtcgccacccgatgcgtttccactcgaaaagtggtgtttgggagctctttttaccaaaagccagtttaggacagctctataagtttgaattaattgattgccatggcaatcttcgtttgaaggccgatccatttgcctttagttcgcaacttcgccctgatacagcttcgcaagtcagtgccttgccaaatgtagtggaaatgactgaagcacgcaaaaaagcaaaccaaggcaaccaaccaatttctatttatgaagtgcatttaggatcttggcgtcgtaatttagaaaacaatttttggctagattacgatcaaattgctgatgaattaattccttatgtaaaagagatgggctttacccatatagaatttttaccgctttctgaatttccgtttgatggttcttggggttatcaaccacttgggctttattcgccaaccagtcgctttggttcacctgaagccttccgccgtttagtaaaacgtgctcacgaagcaggcatcaacgtgattttagattgggtgccagggcatttcccaagtgatacgcatggtttagtcgcatttgatggcacagctttgtatgagcatgaagaccctcgcgaaggctatcatcaagattggaataccttgatttataactatgggcgtaatgaggtcaaaaatttcttatccagtaatgcactgtattggcttgaacgttttggcgtagatggtattcgcgtggatgctgtggcttccatgatttaccgtgattatagccgtgcggagggcgagtggattccaaaccaatacggcggacgtgaaaatttagaagccattgagtttttaaaacacaccaactggaaaattcacagcgaaatggcgggagcaatttctattgcggaggaatctacctcttttgcaggcgtaacccacccaagcgaaaacggcggcttgggcttcaatttcaaatggaatatgggctggatgaacgatacactggcttatatgaagcttgaccccatttaccgccaatatcatcacaacaaaatgacctttggaatggtgtatcaatatagcgaaaattttgtgctaccactttctcacgatgaagtggttcacggtaaatattcacttcttggcaagatgccaggtgatacgtggcaaaaattcgctaacttgcgtgcatattacggttatatgtggggctacccaggcaaaaaattactctttatggggaatgaatttgctcaaggcagagaatggaattacgaagaaagtttggactggttcttgcttgatgaaaatattggcggaggctggcataaaggcgtattgaagctggttaaagacctcaatcaaatttatcaaaaaaatcgaccgctctttgagctcgacaactccccagagggtttcgattggcttgtcgttgatgatgcggcaaattctgtgctcgcctttgaacgtcgcagttcaaacggagaacgtattattgtcgtcagtaactttacccctgtgcctcgccacaattaccgcatcggcgtgaatgttgcaggaaaatacgaagaaattttaaataccgattcgatgtattacgaaggttcaaacgtgggcaattttggttgtgtcgcaagtgaacaaatcgaaagccacggacgagraaattcgatttcagtgtccattccgccgttagcaacagtttatttgagattgaagacgaaataatccgaatagataaattgtaggggcgaattacattcgcctgataaaccaccgatgtttttgggcaaatgtaatttgcctacaaaatcgataaaaatatgttcaaaatctacaacaacggcaatcctattccaatgggatactcacaagcggtcgaaaacaacgtgcaaattaccaatttcgccctgttttccgctgcggcaataggcgtagaactttgcctttttgacgaacaaaatcaagaaacacgcttgccgatggtgcgtactgaaaatgtgtggcatttggcggtaactggcgtgaaaactggtacggaatatgcttttcgtattcacggcgaatttgccaatccgcagaaattgatactcgatccctatgcgaaagccgtgaatggtaaacctgatttaagtagcgaagaaagtcgttcttggttcttgctttcggataatcgcgacaacgcgcatcttgccccaagagcggttgtaatttcagaggaatttgattgggaaaatgacacttcacccaatacgccttgggctgaaaccattgtgtatgaattacatgttaaagggtttagccagttaaacgagaaaatccctgcggcgttgcgtggtacttatactggattagcacatcctgtgaatttggcgtatttgaaagaattaggcgtaactgcggtggagttgctgcctgtaaatttccatataaatgaaccgcacttacaggcacgaggcttacaaaattattggggatacaatcccttagcgatgtttgcggtagaacctaaatatgcggcaacaaataatccattggctgaatttaaaacgatggtaaaggcatttcacaaagcaggcattgaagttattttagacgtggtatttaaccattccgcagaatcagagcaaacttacccaacattcagccagcgtggtattgatgatcaaacttactattggcgcaacgatcaagggcgttatatcaattggacaggctgcggcaatatgctcaatttatcctctgatgtagggcgaaaatgggtggtggattgcctgcgttattgggtggagcaatgccatattgatggattccgttttgatttagccactgttttagggcgtgatacacctgatttcaactcgtcagctcagctttttactgacataaaaaatgagccaagtttacaaaatattaaattgattgccgagccgtgggatattggacattacggttatcaagtcggcaatttcccaagttattttgccgaatggaacgaccgattccgtgatgatctctgccgtttctggctatggaaaagtggcgaaattggtgcatttgcagaacgttttgcaggttctagcgatttatttaagaaaaatgaccgcttgccacatactacacttaattttattaccgctcacgatggttttacgcttaaagatttagtgagttataaccaaaaacataacgaaacgaatggcgaagaaaatcgtgatggtcgcaatgaaaattacagttataaccatggagtagaaggttctacagaatccctttctgaaccgcaaaaaagtgcggtggaaaataaccgcacttttgcacaaagtggattattaatgagtttattgctggcgaatggtacacctatgttgttagctggcgatgagttcggcaacactcaatatggtaacaataatgcttattgccaagataacgagattacttggctgaaatgggcaaattttaacgaagaattatttgaactgaccaaacaaacgattgcacttcgtaagcaaattggcagtttaaataaagatcaatggtggtcggatgagaatgtgcaatggcttaacattgtaggcgaaccgatgacagttgaagattggcaaaatcaacaaaccaaagcattacaggtggttttagacaatcgttggcttttgttgattaatgccaaagccgaaggtcaaatgtttcacttgcctaataggaaatggaagccccaaatcggcacacataatgtaacccttgaagcacaacaagccgaacttagttcaatgggcttttgtatgctgaatgacgaataacaataagactatggagatccttatgaaatctggcgaccttaacaaatatgatttagttaaaaacgctttggtacttgttctcgcaggtggacgtggttcacgtttacacgaattgacagataaacgtgcaaaaccagcgctttattttggtggtaatcgtcgcattattgattttgcactttctaattgtattaattcagatttaaaccgaattggggtcgtgactcaatatgcggcacactccttgcttcttcatttgcaaacaggctggtctttcttaccgcaagagcgtggcgaatttgtcgatatgttgccagctcgtcagcaaattgacgattctacttggtatcgtggcacggcggatgcggtatatcaaaatatggctattattaaaaatcactatcgcccgaaatatattttgatcttagcgggcgaccatatttacaaacaagattacagcgtgatgttaatggatcacgtcaatagtggggcaaaatgtactgttggttgcattgaagtgccccgttctgaagcacacgaatttggcgtaatggctgtaaacgaaaacttgaaagtaaaagctttcgtggaaaaaccaaaagatccgccagcaatggtgggtaaacctgatgtttcgcttgcctcaatggggatttatgtatttgatgcggattatctttataaaatgcttgagcaggaagttaataccccgcaaactagccatgatttcggtaaagatgtattgccaaaatgtttagaagaaggtgcgctttatgctcacccatttagccgttcttgcatgggacgcaacaccgagggcgaaatttactggcgtgatgtagggacacttgatagcttctggcaatctaatatcgacttagtctctgaaaatccacaattagatatttacgaccaaagctggccaattcgtggtaatcctattcaggcttatccatcaaaatttttctacaaacactctaatgtgcaccctgtagataactcacttatcggcggcggttgtgtgattaccgatgcgtcgatcagcaattctgtattattcgaccacattaaaattgatgcattttcaaaagtggatcactgcgtggtgctaccacaagttaaaatcggtaaaaattgcgtgttgaaaaattgtattatcgaccgcgaatgtgaaattcctgatggtatgcaaattggtgtagatatggaagaagataaaaaacgcttccgtattagctctacaggtaaagtgattcttgtgacctcgaaaatgttaaagatacttgagggacacgagattggcgaagaaggacatttagattagttaggaaaagtgcggtcaaaattaaccgcactttctgaacctcctctttagcaaagagaggagttgatcgagcattatttatatttatagggaaaataaaaaactcaatgaaaatactacacgtttgttcggaactctatccgctcttaaaaacaggcgggcttgccgatgttttaggggcattaccccaagcacagaaccaaattgggctagatgcccgctttttattgcctgcttatcctgcaattacaacaggtattccgaatactcaagtggttgctgaatttgacaacttcgctgggcacgtggtgttgcgttatggagaatataatggtgtcgggatctatttgattgacgctccgcacttatacggtcgcgaaggcaatccttatcatgatgcctattacaatgactacggcgacaactacaaacgttttgccttgctcggttgggtgggggcagaattagccacaggtttagatagctggtggcgtgcagaagtggtacacgcccacgattggcacgcaggtttgtgtgtagcatatctgttcaacaaaggcaagccagcaaaatcggtgttcactattcataacttggcgtatcaaggtcagttttcttatcatcatttgtatgaaatcggcttgccaacaggaatgttccacgtagaaggcttggaattatttgggcagatttcttacttgaaatcaggcttgttctattccgatgcaagtacggcggtaagtccaacttatgcccaagaaatcacgacaccagaatttgcctacggtttgcaaggcttgctttctggcttaaaagctcaaggtcgtttggtggggatattaaacggcgtggacgaaaatatttggcatccgaacgtggatcaatacatcccacaccattacaagctgaaatatatggcaggtaaaaagaaaaacaaagctgaactgcaagcctatttcaatttgccacaagatgaatctgctttggcatttgtgatggttacccgtttaaccgagcaaaaaggtgttgatttattaatcgaaagtgcagacgaaatcgtcaaacaaggcgggcagttgatgattttaggttcaggtgcaccgcacttggaacaaggtattcgtgagcttgctgaacgttatccacaaaatattgcggtaaaaatcggctatgatgaagccctttcgcatttaatggtggcaggtggtgatgtgattttagtgccaagccgtttcgagccttgtggcttaacccaactttatggtttgcaatatggcacactgccacttgttcgtaaaacaggtggtttggcagatacggtggtggatagcacttcagaaagcatcaaagctcgcaccgcaacaggttttgtgtttgaaagtgcaacgcctgaagctctccgccattgcttgcaacgtgcctttgccttatggcaaaaaccgcgtgcgtgggcgatggttcgcaccgatgcaatggaacaagacttcagctggcgtaaggctgcagagcaatatagaacactttatgaacgcttgtagttttattcgtaaactttcttaacaatccaccgcttgtgaaagaatattttgcaagcggtgtgattgggcttgttttttgcaaagataagcataaaattcgaactacttttgtaggctgtgtaaacaacattcacgtactcaaagagcggtcaaattttgattgatttttgcaaacgtgcgtaaattttgaaaattcacacaccctacgttaattatttcttagcattctaatagaggttttacctatgataatggataactttgattctccattccaatataatcgtcctgaaatgaccgttgaagcgattaaaaaatcaatcgtttacaaacttattttcttaatcggtcgctctccacgtgaagccagccaacgcgattggctaaatgcaacactccatgctgtgcgtgatttagtaacagagggttggatcaccactgcacgtcaaactcgagcagaagattctcgccgtgtttactacctttcaatggaatttttaatcggacgtaccctttctaatgcgatgattgcagaaggcatttatggattagcacaagaagctctttctgaattaaatgtggatttagaagaagttttagaaaaagaagtagatcctggcttgggcaatggtggtttaggtcgtttagccgcttgttttatggattctattgcgactcttggtttaccaggtatgggttacggtattcgttatgaatatggtatgttccgccaaaaaattgaaaacggtcagcaagtagaacgtcctgatgcatggcttgaaaaaggggcaccttgggagtttattcgcccatctaaacgctttaccgtagaatttggtggaaacattcatttcgagggtaaaaaatgtatttggcaagataccgaaaaagtgaccgcacttgcttacgaccaaatgatcccaggttatcaaaataattctgctgcgacattacgtttatggtcggcacacgcaggcgaagtgtttaaccttgccgacttcaaccgtggcgaacatttagccgcattagaagagcactccgcaaataaaaatttatcacgtgtactttaccctgatgattctacttggaatggtcgcgaattacgtttacgtcaagagtatttcttagtctctgcatcacttcaagatattttacgccgtcacaaacgcacccacaatagccttgaaaacttggcggataaagtggcgatccacttaaacgatacccacccagctttagcgattcctgagttaatgcgaattttagtggatgatgaaggttttgaatggaaaaaagcgtgggagatgacgcgtaacattttctcttacacctgccatactttaatgtccgaagcgttagaaacttggcctgtggaaatgatggcgaaaatcttaccgcgtcatttacagatgatttttgaaatcaatgatcatttcttagaatatgtccgcacttatgtgacaactgacaacgattttatccgccgtgtttctcttatcgaagaaggctaccaacgcaaagtgcgtatgggctggttgtctgttgtaggttcacacaaaatcaacggggttgccgaaatccattccgatttaatggtaacatccactttcgcagattttgctcgcattttcccagaacgctttaccaacgtaacaaacggtattacgccgcgtcgttggttagccgtggcgaatccacaattagccgcattgtttgataaatatatcggctcagaatggcgttgcgatttaagccaaatcgaaaaactcaaaccgttcgcacaagnaaaagcatttaaagaggctgtcgctgatattaaatttgccaacaaagtgaaattggcggaatacgtgaaatctgaattaggtgttgaacttgatccacatgcgttatttgatgttcaagtcaaacgtattcacgaatacaaacgccaaatgttgaacgtattacatattatcgctcgctacaatgaaatgcttaccaaccctgaaaaagattggcaacctcgcgtatttattttagcaggtaaagcggcttcggcttattatgctgcgaaacaaaccattcacttaatcaatgatgtagnaaatgtaatcaacaacgatgaacgtttgaaaggtcgcttgaaagtagtgtttatcccgaactacagtgtaagccttgcacagcttatcatcccagcagcagatatttctgagcaaatatcccttgcaggcacagaggcttctggaactagtaatatgaaatttgcccttaacggtgcattgacacttggtacgcttgatggtgcaaacgtggagattttggaaaacgtgggagaagataacatctttattttcggtaacacagtggaacaagttgaacaacttcgtcgagaagggtatcgatcatttgaatactatcaaaacgatgctcaattacgcacagtcgtggatcaaattattgagggtaaattctcaccagaagatcctcaacgttatcatcaactattacaaggcttgcaataccacgattattatcaagcttttgctgatttccgtagttatgtagaaacccaaaaagccgtagatgaaaaatacaaacaacgcgaccaatggattgaaagcactattcaaaatatcgtgaatatgggcttcttctcgtctgaccgcacaattaaagagtatgcggagagaatttggaaagttgagcctgttcaattaggtgattaataataaaattaaaagcaccacaagttttttacttgcggtgtttttttatggaaagtgcggtaaatttttgagatgttttttatgtgggatttttcgtgatccctatcacaatatcttgtaaaaccacttaaaaacgttacctattttcattcaattaatgatacatttgcatccgtttgactttttgtcattttaacgatgaatagacgaaggtttgttcattaatctcatcaacccaatcatcaatcagagggaaacagtatgttaattggtgtacctagagagctgcttgagaatgagagccgtgtggcggcaacgccgaaaacggttcagcaaatattgaaattgggctttgacgtgatcgtggaacacgatgcaggttttaaagctagttttgaagatcaagcatttttagaagcgggcgcgaagatcggtacgtcggctgaaatttggcaatcggatattatcttcaaagtaaatgcaccgacagatgaagaaattgctcaaatgaaggaaggggcagctctcgtgagctttatttggcgcatgcaaaatcctgagttaatgaaaaaactcaccgcgaagaaaattaatgtgttagcaatggatgcggtgcctcgtatttctcgtgcgcaagcattggatgcgctttcttctatggcgaatatttctggttatcgtgctgtcattgaagctgcgcatgaattcggtagcttctttactgggcaaattactgcagcaggtaaagttccaccagcaaaagtgttggttattggtgcgggtgtggctggtttggcggcaattggtgcagcaaatagccttggggcgattgttcgtgcttttgactctcgtcctgaagtgaaagagcaagttcagagtatgggcgcgagcttcttagaaattgatttcaaagaagaaggtggcagtggcgatggttatgcgaaagtaatgtcggaagaatttaaccgtcgtgcgatggagctttacgcagaacaagctaaagaagtcgatattattattactacggcagccattccgggtaaaccagctcctcgtttaatcaccaaagaaatggtggattcaatgaaaccaggttcggtgattgtggatttagcggctgcaactggcggtaactgtgaatatacgcaagcagggaaagttgttacaactgaaaaccaagtgaaagtgattggttatacagatttcccaagccgtttaccaacgcaatcttctcaactttatggcacaaacttagtcaatttattaaaacttttgtgcaaagagaaagatggcaatattaatattgattttgaagatgtggttcttcgtggtgtaaccgttgttcgtgatggggaagaaattccaccagcacaaattcaagtgtctgcacaaccaaaacaagaaaccaaagctgcaccagtggcagagaaaaaagaatctaaaccaacagatcctcgtgtgaaatacggtgtgatggctggtgttggcgtgttattcctttggttagcttctgtggcgcccgctgcatttttatcacatttcaccgtatttgttttagcttgtgtggtgggttattacgtggtttggaatgttagccatgcacttcacacaccattaatggcagtaacaaatgcaatttcaggcattattattgtaggtgcattattacaaattcgtcagccaacaggcaatctatttatcgatgcgttagcttttgtggcgattttggtggcaagcatcaatatttttggtggtttccgtgtcacacaacgtatgttagcaatgtttagaaaaggttaaggagcgcacaatgtctgaaggtttagtacaggctgcgtacattttagcagcattacttttcattatgagcttggcaggactttctaaacatgaaactgctaaagcgggttgttggttcggtattgttggtatgacaattgcccttattgcaaccatttttggccctcattctgaaggaacattttggatcattattgcgatgatcattggtggagcaatcggtgttcaacgtgcattaaaagtagaaatgactgaaatgccagaacttgtggcgattcttcacagttttgttggtttagcggctgtactcgttggctttaatagctatggtttacaccacgaggcgttaatgccagaaggattagatgcagcagcacaagccgcatttgtagctgaacaagcggtattaacgaatattcataatgtcgaagtctttttaggtatttttatcggtgcggtaactttcactggttctgttgttgcatttggtaaattaagcggaaaaattaattcaaaagcattaatgttaccgcatcgccataaattaaatttagccgcacttgtggtatctgcattattgatggttgcattcttgaataatccagaaagcattttccctgtgttattaatgacagcgattgcgcttgcatttggatggcacttagtggcatcaatcggtggggcagatatgccagttgtagtatcaatgcttaactcatattctggttgggcagcagctgcagcaggttttatattgaataatgatttgctcatcgttactggtgcgcttgttggttcttctggtgcaattctttcttacattatgtgtaaagcgatgaaccgttcatttgtgagcgtcattgctggtggttttggtaacgatgttcaagtttcttcaagcgaagaacaaggcgaacaccgtgaaactacagcggaagaagtggctgaattgttgaaaaatgcaagttctgtgattatcacgccgggatatggtatggctgttgcacaagcacaatatccagtcgctgatattacggcaaaattgcgtgaacgtggtgtgaacgttcgttttggtattcaccctgttgcaggacgtttaccgggccacatgaacgtgcttttagctgaagcgaaagtaccttacgatgtcgtacttgaaatggatgaaatcaatgatgatttcgctgataccgatgtggtattggttataggtgcgaacgatacggtaaacccagcggcgatggaagatccaaatagcccaatcgcgggaatgcctgtgttagaagtatggaaagcacaaaatgtgattgtgttcaaacgttcaatggcagtgggttacgctggcgtacaaaacccattattcttcaaagagaatacgcaaatgctctttggtgatgcaaaagatcgcgttgaagatatcttaaaagcattataaaaaacacgcataaaaataaccgcactttgggttgcttaagtgcggtatttttatttatagcatttaaatattatcttcatgattttccaaaatttctgaacacaagcccaatccagattaaaaattcaatgaaatgcccgttacttttattggtaaatgtcttctgtttggatagaccacatgaatttctaatttttgttgtttatattctggcaatatttcaataagctcgcctttttcaaaggctctacctaaaataaattttggtaaattagcaatacctagtcccgcttttgccatatttaataaggcaaaaccgctattacttactactttggattggattttgaaacgttgggtttgatttatacgtgaaccaacccaatttacctgattcattgcatttttataaagtaagccattgtgatgttctaaatcatcaggcgtttgtggaataccattcgtttcaagataattaggcgacgctgcaaaatgaacagtagtagttcctattttacgtgaaaccaacgagctatcttccatataaccaatacgaagagcaagatcatagccttcggataataaatcgattttcttatcattaaattcaacttcaatatgcaaatgaggatgcttagccataaaagtgggtaaatttggtgcaataaaaagtaaaccaaaatcacgaggaacggaaatcagtaaatttccttgtaatgaactggtaagctgagtaatgctggaatctgcttcatctaaatcaagcaaaatgccttgacagcgttgataatacatcattccagcttcggtaggcataatttttctggtggtacgttgtaacaatcgtgtttttaaatgttcttctaattgtgaaactaatttgcttgccatcgccacagaaatattttgttgctttgctgccaaagtaaaactttgggtttcaatgactttgcagaaaatagaaatcgcgttgagtttatccatttatagaccttttttgaaaaaatgcttgattttgccaacataactttgcactataccgccaattttacaaaattctagtaatattaggtaatcaaatgagtaaatccttggtgattgtggagtcgccagcaaaagcaaaaactattaataagtatttaggtagccaatatgtcgtgaaatcgagcgtgggacatattcgtgatttgccgacggttggttctagtacaggtgaaaaagctaaaccaatttcaaccaaaggtatggatgccgaagaaaaagcaaaaattaaggcagaaaaggaacgtaacgccttagttaaacgtatggggattgatccttatcacgattggaaagcaaattatcagattttgcctggtaaagaaaaagtggtttccgagttaaagtcgcttgctaaaaaagcagatcacatttatctcgcaaccgacttggatagagaaggggaagcgattgcgtggcatttacgtgaagtgattggtggtaacgatgatcgttttagtcgcgtggtgtttaacgaaatcactaaaaatgccattaaacaggcttttgaaaagcctgaacaattaaatatggwtcgtgttaatgctcaacaaactcgtcgttttttagatagagtggtgggctttatggtgtcgccattactttggaaaaaagtagctcgcgggctttctgctggtcgagttcaatcagttgcggttaaattattagtcgaacgcgagcgtgaaattaaagcgttccagcctgaagaatattgggaagttgccgtccttacgaataatcaaaataaacaagctatacgtttagatgttacggattataaaggcaagaaatttgatccaaaaaatcaaaaagaagcacaaagtgcggtagattttctgaatgtttcagattacgttgtcacagatttggaaactaagccaacaagttctcgccctcgagcaccatttattacatcaacacttcaacaaacggcaagtactcgcttgggatttggcgttaagaagacaatgatgttagcccaacgtttatatgaagcgggttacattacttatatgcgtacggattcaaccaatttgagtcaagatgcgcttaatatggcgcgtagctatattgaaaatcattttggtgcacaatatttaccagaaaaaccaaatttctattctagtaaagaaaatgcgcaagaggcacatgaggctattcgtccatcagatattcgagcattgcctgaatctttagagggaatggaaaaagatgcggtacgcctttatgatttaatttggtgtcaattcttagcatgtcaaatgccacctgcacaatatgatagtagcacgctgaccgttaccgctggcgattataccttgaaagcaaagggcagaattttacgttttgatggttggacaaaagtattgccacagataggcaaaaatcctgaagatcaagaattgccttcagttactgtgtcagaaaaacttgctttaaaagaagtgcaaccaactcaacattttactaaaccacctgctcgttttactgaagcggctttagtaaaagaattggaaaaacgtggtattggcagaccttccacttatgcggcaattatttccaccattcaagaacgaggttatgttcgtactgaaaatcgtcgtttctatgcagaaaagatgggcgaaattgtgactgatcgcctcaatgagtcttttggtgaattaatgaattacgatttcaccgcgaatatggaagataccttagataaaattgcctctggttcagtaaattggaaaactgaattgaatcaattctttaaggatttttctagccagctttctaaagctgaattagatgaacttgaaggtggtatgcgcccgaatagccttgtggaaacagatattaaatgcccaacctgtggcagaaatatggcaattcgtacggcgagtacgggggtgtttttaggatgtacaggttatgcattaccaccaaaagagcggtgtaaaacgacgattaatttaattcctgaagcggaattattgaatgttttagatgaatcttcagaaaccaaagcattaatggatcgtaaacgttgtacaaaatgtggaacggcaatggacagctatgtaatcgatgcccatcgtaaaatccatatttgcggtaataatccaaattgtgatggatatttaattgaagaaggctcattcaaaattaaaggttatgatggccctgttgttgagtgtgataaatgcggtgcggatatgcatctaaaacttggtcgttttggcaagtatatgggatgtacaaattgtgataacacacgcaaaattttgaaaaatggcgaggtcgcaccaccgaaagaagagccagtacatttccctgagttaaaatgcgaaaaatctgatgcatattttgtattacgtgatggtgcgagtggtgtatttatgtcagcccataacttccctaaatcmcgcgaaacacgcccagttaaaatcgctgaactagtgcaatatcgcgagcgtttacctgaaaaattagcttatttagccgatgctccacaaaaagacccagaagagaatgaagcgattgtncgttttagtcgtaaagagaagaaacaatatgtgacttctgaaaaagagggaaaagcgacgaaatggattgttgatttcaccaatggaaaatgggttgaacgaaagaaataagaaaaaaagtgcggtaaaatcaccgcactttttgtttgtaataaattttattatgttttgtagattatctgaggattaaagggctgctacaatttcattaattttattttttgcggacgcttgggctttttcaatcgcctctggcccgaatccaatgccttgtgcataaacaaattgcacgtctgtgataccgataaaacctaaaattgatttcatatattgtgtcactagattttcttcatcatacaatccaccaaatgcacataacaaaatggcttttttgccttttaataaaccctcagagccgtttgctgtatattggaaagtaacgcgcggacgtgcgataaaatcaaaatagctttttaattgtgttggaacgtttaaattatacatcggcgcaccaattatcaatgtttgtgcgttttttaattcttcgattagtttatcagacaacgccagaagttgtttttcttccgttgtttttggttctccacgcacagcaattgcagctgcggtatcaaaatatggaagaggttgttgggataaatcgcgtactacaatgttattaccttgtaatttttcgataacataatcagctaattgattagtttgcgagttatttcctgaaatgctagattttaatactaatacgttgctcatttttattccttaactgggtatttaaaagtgcggttattctagcctttatttttaagagataaagcctttagtcagaaaaacattatttcctttttgtaaaatatgggcatttatttaacaatacttcaagaaagtgatagaattcgccacgcattttttgcctaatttcgctcgttcaatggtaggaatgaagccaagtagggcaaaagtgcggttaatttttatagaattttaaatgaacacgtcacctttcgtatgggtgaccactgtataaggaaaaaacaatgccaattattactttacctgacggttcccaacgtcaattcgatcgtcctgtttctgttctcgaagtcgcacaagatattggtgcgggtcttgctaaagccactatcgcaggccgtgtaaacggagaacgtcgcgatgcgtgctatgttatcgagcaagatgcaacgttagaaattattactgcaaaagatgaagacggtttagagattatccgccattcttgcgctcacttgctcggacacgctattaaacaattattcccagatgtaaaaatggcaattggtccaactattgaaaacggcttctattatgatgtagatttagatcgctctttaacccaagaagatattgatgcaatcgaaaaacgtatgttggaattggcaaaaacaaattatgacgtcgtgaaaaaacgtgttacttggcaagaagcgcgtgatacctttgaaaaacgcggcgagccatacaaaatggcaattttagatgaaaacattgaacgtactgcaacgcctgcgttatatcatcacttagaatatattgatatgtgccgtggaccacacgtgccaaatatgcgtttctgtcagcatttcaaattacaaaaagttgctggtgcgtactggcgtggcgacagtaaaaacaaaatgttacaacgtatctatggtacagcttgggcggataaaaaacaacttgctgaatatttaacacgcttagaagaagcggcaaaacgtgaccaccgtaaaattggtaaagcattagatttatatcatatgcaagaagaagcaccaggtatggtgttctggcacaatgatggctggacaattttccgtgagcttgaaacgttcgtgcgtactaaattaaaacaatacgattatcaagaagtgaaaggcccatttatgatggatcgcgtattgtgggaaaaaacaggtcactggcaaaattacgcagatttaatgtttaccactcaatctgaaaaccgtgaatacgcaattaaaccgatgaactgcccaggccacgttcaaatttttaatcaaggtttaaaatcttaccgtgacttaccaatccgtatggcggaatttggttcttgccatcgtaatgaaccatcaggttctttacacggtttaatgcgtgttcgtggctttactcaagatgatgctcacattttctgtactgaagatcaaattgagagcgaagtaactagctgtatcaaaatggtgtacgacatttatagcacctttggtttcactaatatcgcagtaaaactttctactcgccctgaaaatcgtatcggttcagatgaaatgtgggatcgtgcggaagcaggtcttgctgcagccttagcacacaacggtcttgaatatgaaattcaagaaggtgaaggtgcattctatggtccaaaaattgagtttgcactacgagattgtttaggtcgtgaatggcaatgtggtaccgtgcaattagacttcgcattaccaggtcgtttagatgcaacttatgtagcagaagataatagccgtaaaacccctgttatgattcaccgtgcgattttaggttctattgagcgtttcattggtattattactgaagaatatgcaggtttcttccctgcatggttagcaccaacccaagcagttgtaatgaatatcactgatagccaagcagactatgtacagaaagtcgcaaaacagctttctgatgtaggtttacgcgtgaaaactgatttacgtaacgaaaaagtgggcttcaaaattcgtgaacatactttacgccgtgtgccttatatgctcgtttgtggcgataaagaaatcgcagaaggcaaagtggctgtacgtacccgtaaaggtgctgatttaggcacatttactgtggaagaatttgcggaaatcttaaaaaatcaagtaagaagccgtgaattaaagttattgaatgaagaataatacttctagaaaataaccaatataatttactgtttaaatagtgagttcaaacggtgatcgtttaagcgatcaccgccctttttatctatttcatatctattgagatttaatttattttctaataagaagctgcttttaatatgctgacaaatctgcctgatttttttagagctttttgcgccaacgcatctattgtggcttttgtcgctaactgatctaaatgttgataggtataaatggcatctggattatcttgttgccagtaactttcttcaataattgaagcaattgaaactaaagaatcaaattcacgtcgaatctgagtatgttgttccgctagttttttacgtaataagttttcatcaatgccattttttataatgtcatctagtacctgatttgtaagatacgtaagttcctccacgcgcttagggtcgcaactaaattcaattttcccctcaatttgtggtgcataaacatcttgcataaaccaactatttacagaataaataccagaaactttttcacgtagaattaagcgtaatttttcttgcacaatatccgcaagaatattgaataaatatttttgttctgttcgccaagtattatctgcggtaaggtatatttctacatcagctctcggttctttcaaaccattcataataaatgattgagttggtgtatgaataatagtcgggacaaaatggcggatctgagtttttgattcaatagaagctaaataacgttctgccaatttctttacttgattaagttcaatatcgccaataataaaataggtaaaatctgttttatctaaaatataatgttgataagcgttatttaattggtttttatcaaatgataattgttgtgcttgtttttgagtatagacggtttcaatatttggaaaacgtagttttgaaacggcttgcataaattgtgtttctaaatcaatctgtttgaaataatcacgggtttcacgtcgatatttttctaaggcaagatcggatataggagaagaacgtaattttaagcggaacaatgtcagtaaattttccaaatccttaggtttagatacaccagtaaaaccttgtttatcatcatcaatcacagttgcaatcaccaatggatcgcgcgaaaaaatttgattaaccgcagaaagagaaagttctccaacacctgtttcatcaactacactaacggcagcacgtaataagtgatagtccttatttgggatagaacgtaaaccaccttgagtaacagcacgaaaatgtacttgatttggagttttgtcactatagtggtagatcaatttacttccattacttaaacgaaattcataaatatcgccgcgatcccagtatttttcttgagaaagtgagcctgtgttaaatgttaagtgcggtaatttttcgatttgttttttttcatcccattggtgttgttgcatttccattacattgttccaacgagtttctatttctgcaacatcaaaaggcaaggctttttgtggcaaaggttgagtgattaataataattttncttttaatgctaaggtttgatttaacgtgcgtngtaaatcagctaatgtaatttgagataaaaaacgtttattgagttcataacgatcatttacgctcaataccacttgcttatttgccacagaagtaatgagatcatcggcaatttttaaactaccagaacgaatatttaattgtttttcattgagttgagttaagcgtttaatctcaccgcttaattcattttgagtaaaaccttgttgttttatactggcaataaaggcaaataatttatctatcgtttttgaatattgtgtatctataagctggagagaaaaaatgctttgtagtgtttctttacctaaatgagtgcgataaaaatttgcagaatctacgccattttctgtttccttttcccattgctgtaaacgtaagtnaagcaatcgagtggtaatttgctgaattaattcctgtttataactcgctaatgtattggtttcaattgtattttcaaaaaaacttaattcaatactcggaattgttgtgccttgttcagaaatagaatctaatcgccatttgttgataagaggaatattaaaatcaattttttccaatgttgttttagtaattgggttttcttgagatagattttgttttaatagttttactacttgttttgtatcaatatcgcctacaataattactgacatattatctggtcgataccatttgtggtaaaaatcagcgacgcgtttagctgaaattgttttaataatatccatatctccaataggatcacgcaacacataacgagaacccgccatttcaatagcacttttcttattgccaatacgtagcattgggcttaaacgtctccgccattcttcttgtactacgccacgttcgccatccacatctttaggcaaaaaagtaatattattcatccattcattgatgacatcaaaagccaattctaatttttgctgattgttgctatctaaatttaaagtatagactgtattttcaaaatcggtgaaagcattaatatctcgtgcaaacttcattccaagtttttctaacgcattaataatttgattttctggatatttctttgagccattaaatgccatatgttcaactaaatgagcaatgcctttttgatcgtcatcttcgtgcatagatccagcattgatcactaatcgaatataaacgcgttctttgggttcagtattttttaatacaaaatattgcagaccatttgatagtttaccgtgctgaatatttggatcaaaaggtaaattattattgggcgatagttccaatgattgacaagcaattagtgaaaagataagtaaaaaaagtgcggttgtttttttcattattttacctagaaaaaagaaaactctacgctaagtaaaaataagcgtagagtagggctagtggatgtttcaaaagcccacaagccctatacattgaagaatattagaattgatagccaacttctagccaaaattcacgcccaggcgtataaacaccgtattcatcgctagtggaaatagtagtgactttatttttacgtgttttattgagcacatttaaaatatctacttgcatataaacgctatgtttaccgcgaatggtgggttgccaacggatactactgtcccattgtgtatgtctgccatagtgatagctacggaagcgtgaaatgccatcaccgttatcgccatcaagttcctcatagctacgaattggggctttcatatacactttattagaccaagtgatattgtaatctggtatcgtcatatcaatacctaaacgagcaatccaatcttctgtactgctattaacttgttgtagcatttgactacgagtcattaattttccatctaaatagacgggttcatttggattaaattcattacttacatcggctcgttttgtatttaaccaatcaaaaccaagtgacgtagtccaataagttttacctagtttccaaggttcaatattattaagttggaaagtataaatatcaacaccaaacggatgtccattgatataactagtttttctttcaccctgtataggctctcgtttcaatatgatacgattcttattatcacgatgaatataaccaagttttagtgcgaaattacccatattttgatcaaaacttaaacttaattcatctgcataagggctttttagggatgaaaaattttgatgctgacgtgttgaatcattattgagctttaaaataccattcgctaattttaacgaagcaaaagaacgaccgtaataacgatttaaacctagtgtaaatcctgtattatcccaagggtgataacgtgcaacaaaacgcggagcaatattattgttttttaaataatcatcacgttcaatacgaatgccaggacgcaattcaaatttattccattttattaaatcttcagcataaatagcgatattttgataactggttttaacacgaccttttgatgttgtattttctgtagaagttggaggttcttccatacttccatcactttttaaagtagataatattatttttgaatgaacatcttgtggacgatagaattgatatttagttgcctgataaattccaccaacagaaatagaatgctccgtagaagctaaataaaaaggatccattacatattcagttgaaaaatgcaaattatcctgaattaattgactattgccatacccgcctttttcgaaattataaagtggctcataatattcatctaacaccgatgttatttcaacactattcgaggatgatttacgcttatcctgaaaacgatcgtatgctaaggtatttgtccagacgccagagttgaatgaatgtacccaagcaagcgttgctcctaatgcttgatgataatcgcttacgttgttatttatatttnccttgaaatatttcaattccttataatttgaataacgtaaaccaaattcaattcgttctttttcttgcggtgtccaattgaaatttaataaaagattatcggaaagccgttgatgattttgtttgtctaactgtgctttattattggcatctttatcaaagccaattaaacgattttgttcaatagatgatgttctacggctatagccaaaaaccattcctaaattatcatttagccttttttcagccaaaatattgaatgtttgtttattgtatttaggttgtaactctgccactccgacatcatctggacgtaccaacttcagtattttttgtactgagtctccagcttccatttttgcccaagaggaatttgtcgtgcgatatttaagttttatgctatcagtgccactatattgtttcgttttagcgataactgcccctcccataaatccccctaagctagcagaaatattactatcttgtacttccactttagaaagcatagtcgcatcaaaaaaataagcttgagtgtgactaattcctggcacaacttgcatagcaccgtcaaaaatactgctatcaatagcaagatcattatttatattgacattatcaacaaagtaggcgctttgatttggatcggcgccgttaattgaaatattttcaggcttgatttcaccacgttgaaaaccattttggtcgctattttcataacgaatatggggattggaacgaagataatcagtgatgttaccgtttgatgttggtgttttacttatctcatcagaagaaagagttttaacagaagaaagcgatttattattgtcaccatacacaacaatttcgggcaatatatttttattggttgtttcaatagttttccccataacaaatggactgacaaatgttgagcagaataacaacattaatggctttttttgatacatagtatagttccctaaaataaaaatacaaataagaatgattatcattatatttttaagatttatgaatgcaaggggaattcgacttaaaataggtatcaaataaataaaaaaccgcactttaaaagtgcggttatattcaattctgtttgtatggaagaaattattctacgccaaccattacagaagttgctttgatgattgcgtatgcttctttaccaacttctaagtttaattctttaactgctgctaaagacacagtagaagaaagtacgttaccgccaccgatatcgatgtgaacgattgcatttactgaaccgttttcgattgaaacaactttaccctttaattggtttctagcactaattttcataacatttccttgttagttagggtttaaaagagcctgtattttatcttacaaaaaacaagtcgtaaataaacccagagtttaaaactttcagaaaattgaccgcacttttataggcattttgcaggtttcggcaagcctgctaattttgtggcttgttttgctgggccttcaggaaataagtgttgcaaataacggctattacctttatccgcaccaagcttttcagccatggcttttaccaacatacggatggctggggaggtgttatattcttgataaaagtctcgcacaaagtaaatcacttcccaatgggcatctgttaattcaatactttctaactgtgcaatagcacgagcggcatcttcgttccattgttggctatggagcaaataaccgtctttgtcagtttcaacttcaattccattgatattcaacatattaatttacttctttaaagttaatcatttccttgtttgaaaaatcagtttgatcttcgtcctcaaattgcattggcgtgattcgttcttcatcaaatgcggtatcgccttcaatgccatcaattagttgcccatgtttgatgcctttgaaatcaaataatttcggatcacacatatgtgacaatgtaatgttttgcattgcgctaaacatagtttctaagcgtccaggatattgacgatcccaagtattaagcatttcttttacgacttggcgttgaagatttggttgtgagccacataggttacaaggaataatcggaaattccttcgcgatggcatatttctcaatatctttttctttgcaataagcaagcggacgaatcacaatttgtttgccatcatcagaaatcaatttaggtggcatggattttattttgccgccataaaacatatttaaaaatagtgtcgctaacatatcgtctcggtggtgccctaaagcgattttggttgcaccaagttctgtggcggtacgatataaaattccacggcgtaggcgagagcagagtgaacaagtagtttttccttctggaattttttctttcacaattccgtaagtattttcttgtacgattttgtaatcgacgccaatgctttctaaatattcaggtaatacgtgttctggaaaccctggttgtttttgatcgaggtttactgccacgatatcaaatttaatcggtgcactttgctgtaaattcaacaaaatatcgagaagcgtataactgtctttgcctccggataaacacaccatgactttatcgccatcttcgatcataccaaaatctgcaatggcgttgcctacattacggcgaagacgtttttgtaatttattgaaattataggtttgttttttttcttgttgggctaactgggttaattcgctcattctgttatctttagttattcatgaaaggcgcacattatacgtgaaaaataggaaaagtgcggtcaattcaaaagaagatttttaagatccgcaaaaaatcctgtataatctttccaattttttgttcaattttaacgctttgcaattcaatgattgaaacatcccaaactattcctgaactcgtctcttgggcaaaagatcgcgagttttctttgaatttacctaccgagcgcttggttttcctgctggcgattgcaatttataacaacgaacgtttagacggcgaaatgttagaagctgatcttgtggatattttccgccacacgatgaatgcttttgagcaatccacggatgccattgcaacacgagcgaataatgcaattaatgaattagtgaaacaacgtttgttaaatcgttttagtagcgaatttactgagggtttggcgatttatcgtttaacgccattaggtgttggcgtgtctgattattacattcgtcagcgtgaattttccgcattgcgtctttctgtacagctttccattgtggcagatgaaattcaacgtgcttctgattcagcagaagagggcgtggagaataacgaaaacgaacattattggcgtcgtaatgtgtttgcgccattaaaatattccgtggcagaaatttttgatagcatcgatctttcacaacgtatcatggatgaaaaccagcaaagcattaaagatgaaattgcagagcttcttactaaagattggcaagcggcaatttcaagctgtgaacgtttattagatgaaacatctgggaatttgcgcgaattgcaagatacattaaacgccgcaggcgataaattgcaagcacaattattacgtattcaagattgtgtgattgggcgtgatgacttgtactttatcgatcaattaattacagatttacaatctaaacttgaccgaattattagctggggacaacaagccatagacttatggattggttatgaccgccatgtgcataaatttatccgaacagccattgatatggataaaaatcgcgtgttttcacaacgtttacgtaattctattcatcattattttgatcatccttggttcttatggacagcgcaagctgagcgtttagtcgatctgcgcgatgaagaaatggtgttgcgtgaagatgatgctttaggtgaattaccagaagaattgcaatacgaatccctttctgatttacacgatcaaattgtagagcatatgcaaggcttactgattgcttatcgtgaaaataaccgtccgattgatttgagtttagtgttaaaagaacaactggaaaattatccactttctcgtcattttgatgtggctcgaatcattgttgatcaagcagtacgccttggtatggcgaatgatgatttatccggtatttatccagattggcaagcaattaataaacgtggcgcagaagtgcaagcgcatgtgattgataagtattgatttcgtggcttattaaaaaacgaatttataaaatgagaaattaaccatgacagatattcaagatgtaattnccccaaaactcgctgtggcgattgcaaatccaatatttccagcggtggatagtttattgcgctcgggtcgccatatcagcacggaacatttagataatcacgcatttttaatggatttccaaaatgaattggacggtttttatcgtcgctataacgtggaactaattcgtgcgccagaaggattcttctatcttcgcccgaaagcaacgacattaattgcgcgttcagtactttctgagttggaaatgcttgttggtaaagtgctttgttatctttatttaagcccagaacgtttagcccaacagggcatttttagtacgcaagaagtgtatgatgaattattaaatcttgccgatgaaggaaaattattaaaagcagttaatcagcgttcaagtggttctgacttagataaacaaaaattggcagaaaaagtgcgggctgcaattggtcgtttacgtcgtctaggtatgattcaaactgttggtgaacaaaatagtgggaaatttacgatttctgaatctgtatttcgttttggtgcggaagtacgtagcggagatgatccattagagtcccaagctagactcattcgtgatggggaagccgcaacacctgattccttagcgttggaaaaacaagcgcaattaatggaaaacgatacgaaaagtgcggatgaaattgacgaagaatttgacggagaacaagaataatgtctgatgtttttgaattagaaaatgaaatcgaattagagagcgatgaagtcattctggaaaatgaaaacgtcgaagaaatcgttgatgcacctataccttttagcatgacgacaaataatggtatagagcgtggtaaatttcgttctttaaccttaattaactggaatggtttttttgcccgtacttttgatttagacgagttagttaccacgctttctggtggtaacggtgcggggaaatcaaccacaatggctggatttgtgaccgcattaattcccgatttaacccttttacatttccgtaatacaacagaggctggttctacaggcggttctcgcgataaaggtttacatggtaaattgcgtccaggtgtttgttacgcagtattagataccattaattcacgtcatcaacgtattcttgttggtgtgcgtctgcaacaaattgcaggtcgtgataaaaaggttgatttaaaaacgttctcaattcaaggtgttgaattatctcaaaatccaaccgcacttttcactgaaacagtgggcgaacatcaagcacgcgtccttaatttaaacgaactcaaagataaaattgaaaatatcggtgcgcaatttaaacaatatcattccattaccgattatcacggcatgatgttcgatctcggtattattccgaaacgtttacgttcagcatcagaccgaagcaaattctataaacttatcgaagcgtctttatacggtggtatttccagtgcaatcacacgttctttacgtgactatttattgccagaaaatttaggtgtacgtaaagctttccaagatatggaaagtgcattgcgtgagaaccgtatgactttagaagcgattaaggtcacgcaatcagatcgtgatttattcaaacatttaattactgaaaccaccaactatgttgcttcggattatatgcgtaatgcgaatgaacgccgtggcaatattgaggctgcattagaatctcgtcgtgagtggtataaagcaaaagcagagcagaatttatctcaacatcgtttagttgatttaagtcgagaagtggctgaattggcagaaagtgaacgtactttagaagttgatcaccaaagtgcggttgatcatcttaatttagtgttaaatgctttacgtcatcaagaaaaaatcacgcgctatcaagaagatattgcagaacttaccgagcgtttagaagaacaaaaaatggtggttgaagatgcgaatgatgcgttagaagaaagccaagcccaatttgagcaaactgaaattgaaattgacgctgtacgatcccaattagctgactatcaacaagcattagatgcccaacaaactcgcgcacttcaatatcaacaagccattgcagcccttgaaaaagcgaaaacattatgcggtttagcggatttaagtgttaaaaatgtagaagattatcacgcagaatttgatgcgcatgcagaaagtttgactgaaaccgtacttgagcttgagcacaaaatgtctatttctgaagcagcgaaatctcagttcgataaagcgtaccaattggtatgcaaaattgcgggtgaaatgcctcgttctacggcgtgggaaagtgctaaagaattattacgtgaatatccaagccaaaaattgcaggcacaacaaacgccacaacttcgcacaaaattacatgaacttgagcaacgttatgcacaacaacaaagtgcggtcaaattacttaatgattttaatcaacgtgctaatttaagtttacaaacggcagaagaattagaggattatcacgccgagcaagaagcgttaattgaagacatttcagcaagactttcagaacaagtggaaaaccgttctacgcttcgtcaaaaacgtgaaaatttaaccgcactttatgatgaaaatgcgcgtaaagcaccagcatggctgacggctcaagctgcattggaacgtctagaacaacaaagtggcgagaggtttgaacatagccaagatgtgatgaattttatgcaatcacaacttgtgaaagaacgtgaactcacgatgcagcgtgatcaacttgaacaaaaacgtttgcatttagatgaacaaatttctcgtttaagtcagccagatggttcagaagatccacgcttaaatatgctggcagaacgttttggtggagtactgctttcagagctttacgatgatgtaacaattgaagatgcaccttatttctccgcactttacgggccttcgcgtcatgctattgttgtgcgtgatctcaatgctgtgcgtgaacaacttgcgcaattagaagattgccccgatgatttgtatttaattgaaggcgatcctaccgcatttgacgacagcgtattatccgcacaagaacttgagctaggtgttgtcgtgcaagtttcagatcgtgaattacgctattcaagattccctgaaatcccattatttgggtgtgcagcacgtgaaaaacgtttagaagaattacaaattgaacgtgatgaagtggcagaacaacatgcccaaattgcgtttgatgtacaaaaatgccaacgtttacacgaacatttcagccaatttgttgggttgcatttggcgttggcgttccagccaaatccagaagcgttaatgtctgaaattaatcgcgaacgcaatgaaattgatcgtgaattaaaccaatttaatagcggcgaacaacaattacgcattcaattagataatgcaaaagaaagactgcagttactcaataagttaattccacaactcaatgtattagctgatgaagatttaattgatcgtattgaagaatgtcgtgagcaattagatattgcagagcaagatgaatattttattcgtcagcatggcgtaacgttgtcacaattagagccgattgcaaatagtttacaaagtgatccagaaaattacgaaggcttaaaaaatgaattaactcaagcgattgagcgtcaaaaacaagttcaacaacgtgtatttgcgttagctgatgttgtacaacgtaaaccgcattttggttatgaagatgcagggcaggctgaaacttctgaactcaatgaaaaacttcgccaacgtttagaacaaatgcaagcacagcgagatacgcaacgtgagcaagttcgtcaaaaacaaagtcaatttgctgaatataatcgcgtattgattcagttacaaagttcttacgatagtaaatatcagctcttaaatgagttgattggtgaaattagcgatcttggcgtgagagctgatgatggtgctgaagaacgtgcacgtatccgtcgtgatgaattacatcaacaactttcaacgagccgtcagcgtcggtcttatgtagaaaaacaactcacattaattgaaagtgaagctgacaacttaaatcgtcttatccgtaaaactgaacgtgattataaaactcaacgtgaattagttgtggcggctaaagtgagttggtgtgtggttttacgcttatcacgtaactctgatatggaaaaacgccttaatcgccgagagctcgcttatttatctgcagatgagttacgttcaatgtcggataaagcattaggtgcgttgcgtacagcagtggcggataatgaatatttacgtgatagcctaagagtgtctgaagatagtcgcaaacctgaaaataaagtgcggttctttattgcggtgtatcagcacctacgtgaacgtattcgccaagatattattaaaacggatgatccaattgatgccattgaacaaatggaaattgagctttctcgtttaacggctgaattaactggccgtgagaaaaaattggcgatcagttctgaaagtgttgcaaatattatgcgtaaaacgattcagcgtgaacaaaatcgcattcgtatgctcaaccaaggtttacaaaacattgcgtttggtcaggtgaaatctgttcgtttggtagtgaatattcgtgatacccatgccatgttgttggacgcactttctggtcagcaagatgaatatcaagatttattcaacgacaaccgcatcaccttctctgaagctatggcgaagctctatcaacgcatcaatccacatattgatatggggcaacgcacagcgcaaacaattggtgaagaattgttagattaccgtaattatcttgagcttgaagtggaagtattccgtggtgctgatggttggttacgtgcagaaagtggcgcgctttctacgggtgaagctattggtacaggtatgtcaattctcttaatggttgttcaaagttgggaagaagaaagccgtcgaattcgtggtaaagatattgtgccttgtcgcttgttgttcttagatgaagcggcgcgtttagacggtaaatctatttctaccttattcgaactttgcgaacgtttagatatgcagttacttatcgctgcgccagaaaatattagcccggaaaaaggtacaacctataaactcgtacgtaaaatcgcaggcaaccaagagtacgtacacgttgttggtttacgcggattcggtgcgacagaataaaaaatagaagggaagtgcggttgaaaacttcggtgtttttgaccgnacttaagcctttaaggaaggaataatgaaaatctttacatcaaaaaaaggacaattatcacagctgaagcagcaaaaatttaagctggaaaaggatattcagcgtttatttgaagaaaatcttaccttattaagtggctatatttttattcgttcggaattttctattaaaaattcacgtattgataccttagcttttgatcctgaaactcaagcctttgtcattattgaatataaaagacaacaaaattctagtgtggttgatcaagggatttcttatcttaatttgatgcttgaatataaagctgattttattgtggaatataatgaaaagcaaaaagtcccacttaaaagaaatgatgtggattggtcacaatctaaggtgatttttgtttcacctgcttttaatgatttccaaattcaagccacgaattttaaagatttacctattgaattatgggaagttaatcgctttgataatgatattattacgctcaatattattaataaatcaaaatcagcaccgaatattaaagctgtttctaatgaaaagagagaagaattctcaatattaaaagaaataaaagtttatcaagaatctgatcacttagctgataaaactgattttattcaagaactatacgaagattttaaacaaggcattttaaatttagatcctgatatcgaaattaataccagaaaactttacattgcattcaaaaaagatcgaaatattgcagatattcgtatccaacaaaagaatttaaaaatttggattaatcttccttatggagagttagacgatcctaaaaatttagcaaaaaatgtatctaatactggtcactgggggaatggagattatgaaatcaccattgaaagcacccaatatcttgaatacattatgagtttaattaaacaagccattaaggattaaaaatgcacaatcttatttttgccattctttgcagcgtagcagtttcagttttactgaaaattgcccgtaaaaaaaatatcattattgaacaagctatcgcattcaactacattacagccatcactttcagttatttcttacttaaacctgattttaaaggtttagaatttactgattacattgcacaaagcgaaaattcacccatttttttagcactaggtttattgctacctagcgtatttattattatgtcaaaagcagtggagtttgctggaattgtacgttcagatgcagcgcaacgtctttcgttatttcttcccattttagcagcgtttttaatttttcatgaaacactaagccaatctaaaatcattggcgttgtattagcctttattggtttgttttgtttattaactaagccaactcaagggcaaagtgcggtgaattttaaaggtgttttaggattaatcggcgtctggtttggttacggcatcattgatattttattcaagcaagtggcgaaaagcggcggtgcatttcctgcaacattgtttatttccttctcgctggcagcctgcgttatgtttatctatttattcttaaaacgtgtgcaatggacatcatcaagtgtaattggcggtatcgttttaggtgtattgaatttctttaatattttattctatataaaagcacatcaaagttttnctggaaatccaacgcttgttttcgctggaatgaacattggcgtgatttgtttaggcacgataactggtgcattagtttttaaagaaagaattagcaagctaaattggctaggtattattttcagtttgtcggctattttctgcctatattatttagataaaattatcgcgtaaaagagagtagtcatggtaaaagatttcagcttttttatttacgattatgaaagttttggtgtaaatccagcaacagatcgccctgcgcaatttgcgggtattcgtacagatgctgattttaatatcattggcgaaccaataatgttttattgtaaacaaaccaacgattatttaccggctcctgaagccgtaatggtaacaggaattacaccacaagaatgtaatgaaaaggggctttcagagcctgaattcgccgcaaatatcttagcagaattttcccaacccaatacttgtgtcatgggttataacaatattcgctacgatgatgaaatgacgcgttatacgttttatcgtaatttcattgaaccttatgaatacagctggaaaaacggaaattcacgctgggatttgttagatttagtacgggcctgttatgccttgcgtccagaaggaattaattgggcttatgacgatgatggaatgccaagtttccgcttagaaaaactcactaaagcaaatagtattgagcatgaaaatgctcacgatgccatggcggatgtatatgcaactattgctatggcgaaattaattaaagaaaaacagcctaaattattccaatatttctttgaaaatcgcggtaaaaaagaaatcgaaaaattagttgatacaggcgcaatgacacctttagtgcatgtttctggaatgctagggaattatcgaggaaattgcacttgggttgcacctttagcttggcatccgacaaaccaaaacgcattaattgtgtgtgatttaactggtgatatcgataatttattagccaaaagtgcggatgaattacgagcagatttatatacaaaaaaattggaattagaagaaaggggagtttcatccgttccgttaaaacttgtgcatatcaataaatgtcctattttagcaccagctaaaactttgttaccagaaacagcaaatcgattgggtattgatcgtcaattatgcttggataatcttgcaaaattacgagcatcttttgatattcgtgaaaaagtggcggatatttttaatgaagaacgtcaatttgcatcgaatgataatgtagaaactgagttatacaatggcttttttagcaatgctgataaaaataatatggctattttacgtagtttacctgcagnaaaattatctgaacatggtttagcttttgaagataaacgtatccttgaattattgttccattatcgcgctcgtcatttttataaaaccctcacacgcgctgaacaaattaaatggaaaaaataccgacagaataaacttgaaaaaagtgcggtagagtttgaagcaagtttacaacgtttagtagaggracattcagataattctgaaaaactatctttgctacaacaagtatatgaatatggtataaaattactaggttagtcgatacgttgtcacattttgtcaaaaagcacgttttaataaaaacgtgctttttttgttgtttttctgggaagaaaatatccaagaagttttccagattttacgtagcgtaatcacatagatttaagcttatttcactttacatttcctttacatttaaactcatccgntcaataactctataaaatgacgcgttacaacgtgttatctagccttattttgtcttgttttgctagtacttgtaacttgtgtataactgtgtgatttatttagtccgtagtttccgctaacccgataactaatttcgcataatataaattatgttaaattgcaaaaatgcaaagtaactttaattataggctataaagagattatttctcctctcttaattagttatacttaatcaaataagatgaacgagtaaattaatttagagccatactatgacgtttatttacagtgttcgattcatgggtgtgaaagtactgcagcatttaaagatttatgcttgattgataaagatttaggtgatttagcaactgctacataatctaaataatataagtttagatgggtgaaaaactaccaagctgtgttttttatgtatctaagctctccactagcccaccatttttgattttctgatgtgttatttactaccgtgtcagctaatacttgcaacatgtattatcattgaatttctttattattttttgatatgacaaagcgtttaggtatgataaacgaaaaactactacccttcgtttcagtactttcaatatttaaatgagaatgatattgtaataaagtatgcttcacaatagctagtcctaaaccacttccaccagttaaatggctacgagattcatcacaactctataaaaacgttctgttaaatgtggaatatgctgtggtgatatgccaaccccattatctatcacgttaaatttaataccctgttcacaagtttcccattgaatttgaatatgacactgtttaccagaatgcttaatagcattataaattaaatttgaaacggcacttcttaattgagattcatttccaaaaataatgatattaggttgaataataaattcaatgtgatgattataagtatttaatatatctgtatcttttcttaaagaatttatcatggctgacatatcaaatttacgaaaatccttatctgaagttgtttctatttktgctaaaaaattaaattgttgtaatagatgttccattcgttggctttgctcttgcattgcmaaaatagcctttttttgtagagggttctgaatattattatctgcaagaatttctaagtaaccttgtaatacggttaatggagtacgtagctcgtgattaatattactcaagaatttttggcgtgaattaagtaaatgaatcatatctgtaatatctcgagcgataactaaaatcatatgagaattataagcgtgcgactgcacctcaatataacgttgattataagttaatagtactaacggtcgtcttttttttggactgaaaaaataatgtttaaattgtycataaaaaataacatcaaaaatattttcctggacttttttatcccaacaaaaatcaaacatctgtggcgcaattgamttacaccaagaaatattaccattatgctgacagataataattgcatctggtaaatacttaatatttytatttattkgagataacaaacgtaaactkgcacattttycttkgtaaattkgatgacgatggtaggctycagttkgagagaatgtycctaattgtaataaagagaatttattatcttgctttaaattgagatatttgagtaaacgatattcattaatatgatgccaagctaaaattaataaaagtattattgcaaaccaaagaataaaatcagaagtaaataaggaaataatgattgccaaatttatttcaacaataaaattcaatatttttttcattgtttatctcgtaaataactagaaaatcgataaccagatcctcgaactgtttggatgtaatgttcacattgaaaaggggctaaattacggcgtaaacggcgaatatagctatcaacagtgcgatattcaacttctagatcattatgccaaatacgatttaacaattgttctctagaataaactttttcagggtgcctcataaaaaaatgtaacaatttaaattctgtrctacttaaattaatttcctgctgttggaaaaacactctctgagcattttcatcaatggaaagttcatcgatttgtataaattgactttgttgttcataaattctcctccatactgcctcaatgcgagctaataaaatttgaggtgaaaagggtttagtgatgtagtcatcagcccctgcatttaaacaggcaatacaatcttcttctgtacttttagctgtgagcataataatgggaatcgcagcatagctttcttgctttttaatatactgtataaatggtatacctgaacgaccaggtagcatccaatccaataatattagtttaggattttcttttatcttgtttatcgctgttttgaaatcgctcgcttcaatcacatcatagtatttttgagataaaaacagtgcgatcatttcacggattgcacattcatcttcaactatcagaatttttctcgtcataatactccttcatttgatttatggcataaaagtgaagtgagaaataatacattctcaccaaacttttactttttaataagagaactcaaaataactaccccattttaccgcgaatataatcttctgtacgttgtatcttgggtctatcaaaaatttgttgtgtttgaccaaattcaactaattcacccaaatacataaatgccgtatagtcggagcaacgtgtagcttgtngcatattatgagttactataaccacagtataatcnngtnttaactcccgtaatgagttcttcaattttcatagtcgaaataggatctaatgccgaacaaggttcatctaacaacaacacactaggtttaatagcaatccctcgagcaatgcacaagcgttgctgttgtccgccagataaactatctccgcttttatgtaatttatctttcacttcattccaaagagcggccttagtcaatgcccattctactcgttcattcatcttttcttttgataatttttcaaacaaacgaacaccgaatgcaatattatcataaatcgacattggaaatggcgttggtttttggaaaaccataccaaccttagcacgaatcagagaaatatccatctttgttgtgagtaaattttcaccgtctaaattaatttcaccagtagctttttgatttggatatagttcaaacatccgattaaaactccgcaataaagtagatttaccgcaacctgaaggaccaataaaggcggtcactttattcttagcgatacgtaaattaatgttttttaatgcatgaaaatcctcatagtagaaatttagattttgcacagctattttggtttcttgtagactaatcatattgcctcattattttttatgttgaaagaagagtcgagtgaaaatgtttaagcaaagcacaaataatgttattagagctgcacctgcccaagctagattattccaatctgtaaaaggacttgctgcatattgataaataactacaggtaaatttgcgataggttcattcatattccaagatagaaattgattagacagagcggtaaataatagcggtgcagtttctcctgaaattcgggcaactgctaatagcacgccagttaaaatccctgatttagctgctcgataacaaatcatcataataacttgccattgagagcaaccaagagctgccgctgcttcacgtaaattatttggtacaagtaataacatattgtccgtagtgcgtaccacgataggaataagcaataaagctaatgcgaatgctccagcccaccctgaaaaatgctcgatttttgatacatataagctgtaaacaaacaaaccaataataatagarggggcagaaagaagaatatcattargaaaacgggtaatttgtgcgaaacggctataacgaccatattctgccaaatacgttcctgccaatacccctataggcgtgcctatcaatgtacccgcaccgacaataaaaaacgaaccaatcagtgcatttaacaacccccctttttcattaggggcaggggtagattgtgtgaataaatcaattgataaagctggaatgcctttggtaattagagtgaataatatccaacacaaccaaaataagccgataatgactgaaatataggaaagccctaacattaatttattgtgtgttttacgccaataaaaacgcaagttttgattagttttcatcttatttcccttttgtttgttgcatttttgtaatcattaatcttgataaaatcaataccatagttgtgataacaaagagaagtaatcctaattccatcaatgcagatttttgtaatccacctgcttcattaaattcgttagcaatagcagatgcgattgaggtagaaggtgaaaataaggaattaggcaattgaaacgaattacctataataaaagtgatagccattgtttcgcccaatgctcttcccaatcctagcatcacactcccaacaagccctattctagtgtgtggtacaatcacttgtcgaaccacttcccaagtggttgcacctaatccataagcaccttcttttaacattggtggtactatactaaagacatcccgcattacggatgcaataaaaggaatgatcattatggcaagcactaatcctgccgtaaataaaccaacaccaaaaggtacgccagaaaaaaataattctaatccaggtaaattccccaaattgtcaattagtactggctgaatatgttcttgaaataatggaacgaaaacaaacaacccccacattccgtaaataatagaaggaattgcagctagcatttcaattgcaatgcttataggacgttttagccaattgggagctagctccgttaaaaaaatagcaataccaaatgaaatgggtactgcgataaataatgcgatacccgccgtaataagcgtacctaaaataggaataattgccccatattgttcttgtacaggatcccaatatgtttctaatagaaaactcccaccaaaacgtttaatactttcccagcttcctatgactaaagaaattaaaatagcagcaagtaaaataaacacaagcaaagcaaacaatgccgtagtctgtttgaataatgattcaatccatgtttgattaaaatatttccgactttttgtgagcataagtattttccaaaattatttaagataaccgcactttattaatgttaagtgctaggttttgtataaagtgcggtataaaataaagagattttattgttttagctctgttttccattgacttttaatggtagataccacatcagctggaattggcacataatctaattcagttgccgcatcttgccctcttgagaatgcccaatcaaaaaaggctaatacatttttagttgtttcaggattgtcagaatatttatttaataaaataaaactcgctgccgtaattggccaagatttttcccccgtttcattggttaatataacacccattcccgccttttcgtgccattttgcgtgacttgcagctgccatgaaactttcattagaaggctgtacaaattgccctgcttgattttgtaatgaaatccaagcaagctgattttgtttggcataggcatactctacataaccaatgctgtatttcatttggcgaacataagaagcaactccctcattcccctttccaccttgacctgttaaccacttcactgatttaccttcaccaacttgatttttccaatcgttcgaaattttagatagataattagtgaagccaaatgttgttccagagccgtctgaacgatgaatcacaataatgtttttatttggtaaaggaagcgttggatttaatgcaactaagtcaggatcgttccattttttaatcttaccaaggaagatttctgctaacagcttacctgataactttaatttaccaggtttaatttcaggcaaattaacaacaggcactataccaccgataaccgcagggaattggactagttggtgttgttgtaataattcggatttcattggatcgtcagaggcaccaaaatcaaccgtttttgcaataatttgctgttgtccgccgcccgaaccgatggattgataattaactttattcccagtttctttctcatataaagatgcccacttcgcataaattggataagggaaagacgctccagcaccagtgatgctattagcttgagcaaaaggtaacgtacctaaggttaaaacgtaataagattttttttcattttatgcataaacataacaaattctccttgagtgttatttagattgcgtagcgaagtgtagaaaataattgtgacagtttgatgacaatatgaaaaattttaaatggataatcaaaagaaagtagttataagaaaagtacaggtaaatttgaccgtgtttttctagcagaaggatattacatttgtcaattaattgataacgatctttaggtttaataaaagttggtaagttttcatgtttactcgataatctaaattttatccaaatctaaggaggaaaataaagacatatctaatactaatttaaaatttgttagttttattgtgacaacgtcatatttaatttatagaattatgtaaatgataataattgttttttatttttctttttaaaattaattagttatatcaaaatttttgataaaaaaacttgcaattatcatttgtgaatttaaaatgattgccgcaaattatgctttattgcattttatcaatcaaaatggaaaggaattagttatgcttaatcaaataatcataaacaagctgaacgaccaaattaacttagagttctactcttctaatgtttatttacaaatgagtgcatggtgttcaaaacacggttatgagggggctgctaccttcttacttcgtcatgctgatgaagaattagaacatatgcaaaaactgtttaattatgtaagtgaaactagtggtatgcctattttaggaaaaattgatgcacctaaacatgattattcttcattaagagaagtttttgaaataactttagaacatgaaaaattagtcacgtcaaaaatcaatgaattagttgaagttacttttgaaagcaaagactactctacttttaacttcctgcagtggtatgtagcagaacagcatgaagaagaaaaattatttagtggaattattgatagatttaatcttgttggcgaagatggtaaaggattattctttattgatcgtgaactcgcaactttggaatagataggagaaaatagtatgttatcagaaaatgtagtaaaactattaaacgatcaaatgaatttagagttttattcttctaatttatatttacaaatgagtgcttggtgcgatcagcaaggctttgaaggcactgcaaaatttttatcagttcatgctgctgaagaaatgcaacatatgcgtaaattatttacttatttaaatgaaactggctcacttgctgtaatttctgcaattgaagcacctgcacatgaatataaatcattaaaagaagtaattgaaacgacctatgagcatgaaaaattaattaccagtaaaatcaatgaattagtaggtaaaacctttgaagaaaaagactactctgcatttaatttcttacaatggtatgtggaagaacaacatgaagaagaaaaattatttagtagtattttagataaattaaattttcttggagaagatggcaaaggcttgttcctaattgataaggatttaggtaatctctctactaaagcctaattatagattatcaaatctggcagatcttttatttaaaataatgtgtctgccagattattttattccaaattttccaaaaatattttctattgcataattacatctcgtaatcttatttctaatcttatcaaaacatattttgccttatattaagtatattttgagttaatcaaggtattataaaaatgaaaaggatctatactgatgaaccaaccaaccaaccaaccaaccaaccaaccaaccaaccaaccaaccaaccaaccaaccaaccaaaataataaaaccgttgcggtagtgacttcaacaattggtcgtccagaattatctttggctattaaaagcgtacaaaatcaaacttatccatgtaagcattatgtatttattgatggcaatattttctgggataaagccaaatctatattggaatacaaaaagcgatattttcgtagatgttaaaatagaagatattcaacaacaactccattttacttttaatgaagttaatggacatattgatactaattgttacgccgtacctcgtgagattgcacaaaaaacttcatatagttggaacacgtcattaattggtgatcgcagctttttatctgccttaaaaagtttggggttaataggtcaaacttcaggnaaatataccgttaaatatagggcagatttcaataaactaattgctgttcgtcgtgtttttcctcaattatccttgtcagatgaagataacaataatatttctgcaaaaatattagaagtgataaatcagcaaaatatagaatattatggaggtcgcccttgggcaaaggaataaaaaatacaatttttaatcaaaaagtataaaaaataaaaatcaggcttgacttattccttttgcactagtttaatagtacaaaattttccaaaaggataaataaatatgaacattcaaactcaagcctttattgcggtgacagctcaacccattccctattatgctgacaccaccgctatttttaatacactttgtcaatccaattcaaattctcttctactcgactctgccgaaatcggtagtaaaaacagtttacaaagccttatcttagtcaatgctgcggttaaaataacgtgcttaggtcacaacgtcacatttaaagctttaaataataatggaaaacaagttttaaaagaaattcatccaaaattaaccgcacttggaaaagtaagtgcggtcaattttgaagacgaattttctgtacaatttttgccacttgataatcaacttgatgaagatagtaaattacagtctgccactatttttgatgggttgcgtgttatttctagtctttatcaacatagccaaacgcctattttcttaggcggattatttgcttacgatctcgtcgcaaattttattccaatggatggcattacattaaaaaatgatggtatcaactgccctgattacagtttctatcttgccgaacacctcattactatcgaccatcaaaatcaacaagcaacactgaaaagtttctgttttgctcaagaagaacaagttaatattgcgaaaacctccctttccatcgcacaaaaactaaaaaatattgatcacgttctttctattaaagcggcaagtgatgaagttaaaacaaactttgacgatcctgaatttactggtatcgtaaaagccttaaaacaccatattaatattggagatgttttccaaattgtgccttctcgccgtttctcccttgcttgcccgaatacattagccagttacgctcaactcaaacaaaataatccaagcccttatatgttctatatgaacgatgaagactttattttgtttggtgcatcgccagaaagtgcgctgaaatacgcgccagaaaatcgtcagctagaaatttaccctatcgcaggttcacgccctcgtggttttgatgctcacggcaacattgatcctgaattggatgcgcgtttagaactagaacttcgccttgatcataaagaacaagcagaacatttaatgttagttgatttagcgcgtaacgacattgctcgagtttgccaaagtggcacccgtaaagtggcagaattaatgcaagtggatcgctattctcacatcatgcatttagtgtctcgtgtggtgggtaaattacgccctgaattagatgcacttcacgcctatcaagcctgtatgaatatgggcacattaactggtgcgcctaaaattaaagcgatgcagcttatttatcaatttgagcagcaaaaacgccatagttacggtggtgcagtgggttatctcacgtccgatggacattttgatacctgtatcgtgatccgttctgcttttgtacaaaatggaatggcccatgtacaagcaggttgcggcgaagtgttggattctgatccacaaatggaagctgatgaaacacgccacaaagccgcggctgtcttaaaagcaattcgtcaagttaatacacaagcaaaataaggaagaattattatggctaatattttatttttagataacttcgattccttcacttacaatcttgtggatcaatttcgtgtgttgggtcacaacgtcacaatttaccgcaatgactgcgacttagaaaaactggtagaaaccgcactcaatacacctgataccattcttggcactttctccagggccaggaacgccatcagaagctgggattttgctaccattaatcgaacgcttaaaaaatcaagtgccgattattggagtttgtttaggtcatcaagcgttgattcaagcctttggtggtaaggttgttcacgctggcgaagtgttgcatggtaaagtttctcgtatatcccatgataacgaagctatgtttaaagatcttgcaaatccaatgcctgtggcgcgttatcattctttaatgggacaagatttaccaaaagaatttatcgtcaatgcggaatataatggcattataatggcaattcgtcatcgcgatttacccatttgcgcattccaatttcaccctgaaagtattttaactgtgcaaggttcgcaattattacaacaatcaattgaatggttgttaaatagataagacatcaaaaagtgcggtaatttttaaccgcactttaaaggagaaaaaatgatcactgtattcggacttaaatccaaactcgcaccacgtcgtgaaaaactcgcggaagtaatttataacagtcttcatctcggattagacattccaaaaggcaagcatgcgattcgctttttgtgtttagaaaaagaagatttttactacccttttgatcgtagcgatgattacaccgtcatcgaaattaacctgatggctggccgtatggaaggcacaaaaaaacgcttgataaaaatgttgtttagcgaattagagtacaaactcggcattcgagctcacgatgtggaaattacgattaaagaacagcctgcccattgctggggtttccgaggaatgacaggtgatgaggcgcgcgatttagattacgatatttatgtttaataaaatatagaaaattaacaaatccatatacaaagaaaaacaggaatagactatgcaacacaaccaattattagaacaactttatagcggacattcactttcaacctcagaaagcaccgctctttttaatgcagtcatccaaggtgagctttccaatgaacaaattgctgcaatgcttattgctttaaaagtgcggggagcaaatactgaggaaatttcgggtgccgttgccgcctcattacaaaatgccaaagcatttccatatccaaattatccttttgcggatattgtaggaacaggaggcaatggtcaaaacactattaatatttccactaccagtgcgattgttgcggcatcaatgggagcaaaaatagcaaaacatggcaatcgtagcgtgtcgagtaaatcaggtgctagcgatgtgcttaccgcacttagcgttaatgtgaacgtcacaccagagcaagctcgacaagcgttagatgaaattggtgtctgttttttatttgctcaacaatatcattctggtttccgtcatgttgcgccagtccgtgccgctttaaaaacgcgcactatctttaatattttagggccgcttatcaatcctgctcgcccaacttatcatttacttggcgtatatgcgcctgaattagtaaaaacctatgctgaaaccgcagttgccttagaacatcaacattcctttgttgtacatggttctggcttagatgaagtcgcattgcacggcgaaacacaagtggcagaaattaaaaatggcaaaattgaatatttcactttaacgcctgaagattttggcttaaaaacgcaatccctcgaaagtcttcgcggtggtgaaccacaagaaaatgcccaatatctgaccgcacttttacaaggtaaaggaaaagctgaacacgctaatgcggtggcggcaaacacggcattattattgaaattattcggttacgatgatttaaaacaaaatgtgcaaaatgtactggcgcatcttgtatcaggtaaagcctttgaaacattacagaaattaaccacatattaataaaagctaattttatacgccacaataagaagaaaaatgatgatcactcaagattttaccaaacccattgattccgctacggtgctacaaaaaatcgtgcttgataaagcacaatgggttaaagcaaaagaaaaggaatttcccctttcacaatttaaacaaaacattcaaaactctgaccgctctttttatgatgcgttagcaaaaggtacgcatcaaaagcccgcttacattttggaatgtaaaaaagcctccccttctaagggattaattcgtgctgaatttaatttggaagaaatcgccaatgtctataaacattatgcgtccgctgtatctgttctgacagatgaaaaatactttcaagggaattttgaattcttgcctttagttcgcgatatcgtaagccaacctgtgctttgcaaagattttatgattagcgaatatcaagtttaccttgctcgctactatcaagtggatgcaattttattaatgctttctgtggtaaatgatgagacttatcgtgtgctggcagatcttgctcattctcttggtatgggcgtattgacagaaaccagtaatgaagaagaatttgaacgtgcccttgcacttggtgcgaaaattattggtgtcaataatcgtaacttgcacgatttaacagtagatttaaatcgtgttgttgaactcactaaaaaatacgccgactgtattcctgctgatgtacgtattattagcgaatcaggcatttacaatcacaagcaaattcatcaattacaaaaggtggcgcatggtttcttaattgggagtagcttaatgggcaaccaagatttgaataatgcggttcgctcagtgatttttggagaaaataaagtatgcggtttaacgcgcgcgcaagatgtcaaaatcgtttacgaaaacggggcactttacggcggattaatcttcgcagaacattcaaaacgcagtgtgagtttacgccaagcgcaagaattagtaaccgctgcgccacttcgatttgttggtgtttttcagaatcaagaaattgactttatcgtcaaaatagccagccagttgcagctttatgcggtgcaattacatggtgcagaaactgaagcatttattactgcacttcgccagcaactaccaaaaaacacgcaaatctggaaagcgatttcggtcaatactgaagcccaaagtgcggtcgattttacagatgatttgaatgtggatcgttatatttttgatagccaaacagcgaaccaacaaggtggcacgggtaaaacctttgattggtcattaattcctgaaaatcttaaacacaagattattttagctggaggtatctcaccaaataatgtggaacaagccattgcgcaaggttgcttaggtttagatcttaattctggggtggaaagttctgcgggcgtcaaagatcaagaaaaagtgcggttagtttttaataatatttattaattttaataacatagaaatcactaaatttcagcttaaatactaataggagtaaaaatattatgtgtttaggcgttccgatcaaattgtcaaaattgatgaaaattctcttcaacttgccacagtagatgtatgtggcgtacaacgtgaagtaaatatttcactagtctgcacgggaaatccagccgatttacttggcaaatgggtgcttgttcatgtgggctttacaatgagtgttattgatgaagatgaagctaagaaaatccaagaggctctgatcacaatgagccaactcgaacatgaagttggagattttttaggactaaatcaaaaataaaaagtaggcataatgcctactttttatgttttgttacaacgcctcaatcgctttatactgctcttggattttttctaatccagattggtattccgcttgtttttcgcgttctttcgcaataaccgcttcaggtgctttagccacgaaagcttcattgctaagtttgttttcgatgcgtttcacttcgttttgatatttttcaatctctttggttaaacgggcaagctctgcttctttattgataaagccagccattggcacaagcaattcagcattgcccacgagtttcgctaccgcaagtggtgctgtttcgtttgtggctaacacttgaacgttgtctaacttcgccatggcttttaaaagagcggtctgtttttcgagaatttttgcattttctgcacttaaattacggaataacagatctaaacctttacttggtgcgatgttgctttctgcacgaatattacgcaccgcaacgatcacttcttttaaccactcaatttcagcttctgcttctggatcaaagccgctctcttccacttgtgggaaaggttgtaacataatgctgtcagcagtaatgccgacaaatcctttcactttttgccaaatttcttcggtaataaatggaataagcggatgcgctaaacgtaataatttttctaacacgtgaaccaaggtttggcttgccgcacggatttgtgctgcgttgccgtttgcaaatactggtttagttaattctaaataccagtcacagaattggttccaggtaaactcataaatcgcattggcacaaaggtcgaaacgatattggcttaatgagctacggaaagtttccactgtgcgattgaattccgattgaatccaacgatccgctaatgagaattcgatctcgccttggcttaaatctaatttttcatttgttaagacgaaacggcttgcattccataatttgttacagaaattacggtagccctctaaacgtttcatatcccagttaatgtcacgaccgtttgaagccaatgcagctaatgtgaaacgcaatgcatctgtaccgtgagccgcaataccttcagcaaattctttgcgagtcgctttagcaattttttctgctaattgcggctgcatcatgttgccagtacgtttttcaagtaaatcttcaaggctaataccgtcaatcatatcgattgggtcaagcacgttacctttcgatttcgacattttttgaccttgttcatcacggatcaagcctgttacatacacggttttgaatggcacttgtggtttgccgttttcatcttttacgaagtgcatcgtaaacattatcatacgtgcaacccagaagaagatgatatcaaaacctgtgattaacacatccgttgggtggaacattttgagctctttagtttgctctggccaacctaaggtagagaacgtccataagcctgatgagaaccacgtatctaacacgtcttcatcttgtttgagttcaaccgcagaatctaagttatattttgaccgcacttcttcttcgttacgtgcgacataaacattgccttccgcgtcataccacgctggaatgcggtgtccccaccaaagttggcgagaaatacaccaatcttgaatatcacgcatccaagagaagtaaaggttttcgtattgtttcggcacgaattggatttcgccatcttccaccgctttaattgccacatcagcaagtggttttacgcttacataccattggtcagttagcatcggctcaattggcacaccgccacggtcgccataaggcactttcaaatcgtgtggtttaatttcgtctaataaacccagtgcttcaaaatctgcgacaattttcttacgcgcagcaaaacgttctaagccacggtaatccgcaggaatagtcgcttcatagccagcaagtggtttgccgtcagtaccgataatttccgcttcatcacgaatatttgcgttcagcgtcaatacatttaccattggtaaattatgacgtttacccacttcatagtcgttgaaatcgtgtgctggggtgattttcacgacacctgtaccgaattcacgatccacatattcatcggcaataatcggaatttcacggttagccagtggtagaacaacagttttaccaattaaagattggtaacgctcatcttcaggatgtaccgccaccgccgtatcgcccaacatagtttctggacgtgtggttgccaccactaaataatctttaccatctgccgtttttgcatcgtttgctaacggataacggaaatgccaaagggagcctttgctttctttattttcaacttctaaatcagaaattgcggtgtgaagttttggatcccagtttaccaagcgtttgccacggtaaatcaacccttcttcgtgcaaacgaacaaacacttcttttactgcattcgataaaccatcgtccatcgtgaaacgctcacgttcccagtcgattgagttccctaaacggcgcatttgttggctgattgtgccacctgaataggctttccaatcccaaattttattgatgaacgcttcgcgaccataatcgtggcgagttttgccttcttcagccgcaattttacgttccaccaccatttgggtcgcaatacccgcgtggtctgtccccgtttgccataaggtgttatgcccttccatacggttaaaacggattaaggtatccattaaggtttgttggaaagcatgccccatgtgtagagaacctgttacgttcggcggcggaattgcaatgcaatagctcggcgcattttcattttcagacggtttaaaataaccgctctcttcccaacgttgataaagggcttgttctaccgcagacggattaaaacggtctgccatttcgaatttttgtgtcatttattttttctctttattataaaagcagttatttttttctatccctaaacgattaactgcaatattatatattccattatttttttcatatccaatgaaatgtctatttaattctttagctgctaataatgtagtaccactaccagcaaaaggatctaatacaatttgttcttcttttgttactaaatcaataagcaatttcattagattaagtggtttttgagcaacatgataacctttatcctcagaagttattcttacttttagtatattagaatgatttaaagctccttgttgtatattccaatgagttaacgaattttcattccaagctccaacttcatgtttgattaaattatcagctaatgtactgccagttttatatggtttttgaaaccataaaataggctcaaataaaggtcgtaaattagcaactctccaaccaacccatttattagtattagcaatatcacctcgacgttcaaacacacaagaaattctttgtgctctatgtggagctttgtctttttcccaactcaacatatctttgaaagtaaaaccactattttcaaacgcaacaacaactctgtgtgcaaattgtcttcctgnaaaaacaaagactgaacttcctgactttaatactctaaaccattcattagaccaactttcaacccactcttgatactcttgcggtcttttcttatcagcctctgaccaaccatttaatggtttacctcttcgtttaaacaatgatgttttgtgttgagctgaagatgttcctcctaatgcactattagtattggaatgcaatatatcccaatcatcataatcaattccataaggaatatcagagataattgcatgaatagaattactatccaatttttttatttcanaaatagaatcagaattataaatacagtctatcattactttttatccctttaataaaactatcaatagtttctatttttgaagacatatttatatctttcaataatgcttctatggcttcttctcttgtaaaattttttataatatttatttgttttttccaatattccttttctatcaaggatctttcttcaataaaattgatctctttttgaagaagttgatttaaagtatctttatctattttaaataaatccataaagtatttattaaaatctctcataaaattattttcagcatcagatacagatgtttttttactttgctttttgggaaagttccataattgctcaaaagraaaaatattagtttcctctaaatctaactgtaataatatagctaaatgttcccaactaaataacaaaacattttcatctaacgattgcttaaaaatttgacttttagttgtaggatattgaaaaaatggtgctgttaatactgcataatccttatcttctcgccattcacttaacgcttttactttaaaatctttttgatttttagcagtacgactaagtcgaaaagatttagcatcagcaactaagccgtaattaaattctttagagagtgctatcacatctccagcattacctctctgttctaatggttttgagttcagattaagtaattgaaaagctttagctaatacaatatctcctgcttttgagaataatttctcttgtgtagaacttggttttattgcctcaggaagtattccaatagatctaaccaattcaataacctcatttctattcaatttataaataaatgagattaaactattagttgcctgtttaaattcttgattagttaaattttctatcagtgataataatttctctaacgcacttttcttcattaaaatactcctttaagctaaattgaattacccaaaagataatctcattcggataaatcccccgaatcacttctttcaactcatccaaccccatattctcctgcttcgcatgtggttgtgtcagttcatcaagggtaatcggcgacacacttaacacttcaatgttgcagaaatattgattatcttcaaaccgccccacacgtaaaatatcgcctgctttaaaatggctttcggagtcatcccgaatgctaatcgttttatgcccagcgagaatatcggcttcaaaacgttggtaaaaagtgatgtcatttggttgcattttgatccttaaagagcggttaggttttagaaagtttttacaaatcctagatttatcaattgatttaatacttttttacaccagcttggtaaaaattcactaaattgagtaatgcagttatcttttagttgaaaaatcaattcaagcgcaatgccagagttatcataaataaaaatttcatcacaatatgacaaaacaagaaataaattatctaaacttatttaataacgatattttacaatatcttcagcaataaaatgaccaccactttttactctngccttaatccgtgcaagatttatttcaacgcgattaataccaatataatttaaatgtacataaaagccattttctttcgccgttttcattctttgaataattgaattacctgaaagtgtcgattccataggaaaaccaatatgttgcttaatagcaaaatgaaatagccctatcgcttttctgcctgcatcaatatcagcaagtcttggattttgaggattaatctgcattgcaatatgatcagaatcaatcacaatttgcacagcatcttggttaaaagaacgtaaagtactttttcccgaaccatttgttccacaataaaaaatcgctttattttgcataacccacaattttttccgaaccatctggataatgctcgactatcttgccatcagttttttgaaagataaccacctcgtgattcattttctctttcatccaaactgaaaataacgctttaagttgtttctgttgttgaataattttctcacgntcagtcatcaattatcctctttaattaattcaaaacctactgctcaatactcaaaattgaaagcgttgataaaaggtaatatcgntcatttattaacccacgttttcagtagaaagattccaaccttgcagacgtaattgtttataacgttctcgagcttgtgtttttaacgcatcatctttcggcacaaaatcaataatttgggtaaaactatggctaaaatctgggatttcttgttgcaaattgattaacaaatcgcggcgttgtaaatttcgttttccaagccatgaaatctcaatcggtgtgggatattgtgttgcctcacccgataaattatgtggaamaaattcattaggatctcgttgccacaaacgctcgtcaatctctagcgcttgagcctcactttcgcaactaattagtacttttttccctgaacgccatattgaagcagcaagattacaggctatttcttcgacagttaaagtacaattttccgtaagaatataaaattgcgcagtttttgccattttagccccgttattttctcaatcttaccctataaaaagggtaaaattttaacgaaaaaaccctaaaaaataaataattaaatatgcattattacaaatgtctgaaaatccaccgcgcttttatgatctatgtcacaaaactgatttttaacgtttttgttncgttccactcataactcggaagtgttaaaatcacttgcgttttaattttcattcaattcataggagtacagaatggcatttcgtattgaaaaagacacaatgggtgangttcaagttctagcagataaatactgggctgcacaaactgaacgttcacgcaataactttaaaattggcccagccgcatcaatgccacatgaaattatcgaagcttttggctatttgaaaaaagcagccgcatttgctaatcatgatttgggtgtattacctcttgaaaaacgtgatttaattgctctggcttgtgacgaaattttagcaaataaattagatgatcaattcccacttgttatttggcaaactggttctggtacacaatctaatatgaatgtgaacgaagtagttgccaatcgtgctcatgtgttaaacggtggaaaattaggtgaaaaatctattattcacccaaatgatgatgtgaacaaatcacaatcttcaaatgatactttcccaacggcaatgcacattgcggcatataaaaaagtagttgagcacaccattccttgtgttgaacgtttacaaaaaacttttgcggcaaaatctgaagccttcaaaaacgtggtaaaaattggccgcactcacttaatggatgcaacgccactcacattaggtcaagaattttcggcttatgcagctcaattagatttcggcttaaaagcattaaaaaataccctcccacatttaagccaattagcattgggtggaactgcggttggcacaggtttgaacacgccgaaagntaatgatttgaaagtggcagattacattgcaaaattcaccgcacttccgtttgtcacagcagataataaatttgangcattagccgctcatgatgcgattgttgaaactcacggtgcattacgtcaattagcaatgagtttatttaaaattgcgaacgatattcgtctattagcatctggccctcgttcgggaattggcgaaattttaattcctgaaaatgaaccaggttcttcaattatgccaggtaaagtaaacccaactcaatgcgaassgatgacaatggtctgtgcacaagtatttggtaacgacaccaccatcgcatttgtgggttcacaaggtcacttccaattaaatgtgttcaaccctgtgatgattgcaaacttcttacaatctgctcaattattgggcgatgcttgcgtatctttcgatgaacactgtgcagtgggtattgagccaaactatccacgcattaaacaacaacttgaaaattcattgatgttggtgaccgcacttaatacgcatatcggttatgaaaatgcagctaaaattgcaaaaaccgcacataaaaatggcaccacattacgtgaagaagcgattaatttaggtttagtgtctgccgaagattttgataaatgggttcgcccagaagatatggtgggtagcttaaaataattcatcgcacaaattaacattacaacgatcaaaggcgagtaaaattactcgcctttttactgatttctaatttgctttttgatgcggtttgttataatcaacaaaattttattcacggctatttattatgaaaatgaaatccctttttgtggcaatgataacgtttttttctgccgcaccttttgctcattggcaacccatcggaaatgccgaatacacttgggggccgttccatgtttataccattggtttgttttctgaaactggcacttatcaagaaaatgaacgtccattaatgctctctttcaaatatgaaaaacccattgaaggaaaaaattttgcgattacgctcattaaagaaatcgaaaccttaaaacttaatgatggcgatactcaaagctggcttaaagaaatgcaagcgacctttcctgatttctcaccaaacgatattttgaactatattgccttacccgatagaggctacttcgtcttaaatgatacagttttagaacacgattttgatgctaaatttaatcaagcatttatcggcatttggcttgcaccgaatagtacttttgtaaaacttcagccacaattattaggcaaaacgaaaagcaatcatgaagcgacagagttttatctcaaacctgaaattgaatcctttgatgaacaagattctacacctgaattaccgccaaattatttattagatagtcagaaaaaatctcaaggataaattcagttttttatattttgcaccataaaaaatacctgtttccgaataaattattatcaaggaaacaggtatttattatttgaacattctctatctgactaaaatttttcccaaactgggataacgctatcaactaaatctaaattttttcctaactcaatccagccacaagggaaatgaaaatcggagccaacggatccctgcagatcaaattcttttgcccaacgagcaagcatttgacgctgatcttttgtttgaccacaatccgccatttccattccatcaccgccccaagccttaaaatcgactatcagcttacgcacccatttccccgtcatgttataacgtaatggatgcgcaataatagctataccacctgcggcatggattgtctcaatcgctgtgggaatatcagcccattcagctttaacaaatgccgattttccttgccctaaatagcgtttaaaggcctgaccatcattagataccttaccaatctgcaccaaataacgtgcataatgagcacgcgtcacttcgccatcggctaaggcttttgctccgtcataagcattaggaatccctgctttttctaatttatcgccaatttccaccgctcttttttcccgtaatgctttttgactttgcaaaagtgcggtcatttttggatgagttttatcgaagtttaatcctacaatatggatccctcgcccttcccaatttgtcgaaatttctactccagtaatcaattcaatgcctacttctttcgctgcaatctcagcttcatcaatgcccgcaatcgtatcgtgatcgcataatgccagcacgttcacgccttgcgcataagcacgatgcactaattcggttggactcaacactccatctgatgcggtactatgacaatgtaagtcgtatttttttgtcattatttaatattttttactaattcttttactaattttggaccgtgataaatcaatcctgaataaacttgcaacaactctgcaccagcctcaattttctcttgtgcattttgcaacccatcaatgccaccgctaccaataatgggaatctgacctttcagttcttgatgtaatcgcttaataatctccgtgcttttatgctgcaacggctttccacttaatccgccttgctgttcggcatttttcatccccgtaaccgtatcacgagaaattgtagtattcgttgcaataacgccatccattttatgacgaaccaatgtatccgcaatttgcactaattcactttccgttaaatctggtgcaatttttaccgcaatcggcacatatttattgtattggtttgccaaaatagcctgacgatccttaatgcttcgcaataaatcatcgaaataatcaccatattgtaattgacgcaaatctggtgtattgggagatgaaatattcaccgtaatataacctgcgtagttataggctttgttcaaacagaaaatataatcatctttgccttgttccaaagatgtaaatttattcttaccaatattgatgcctatcacacctttataacgggcgtttttcacattttctataagatagtcaataccattattattaaaaccattacggttaataatgccttcagcttcaatcaaacgaaactgacgtggctttgcattcccatcttgtgcaacgggcgtgacagttcccagttctaaaaaaccaaaacccaatgcaccaaagccgtcaatcgcatcgccatttttatccgctcctgccgccaatccaatgggattagggaaattcacacccattaccgttttcggaaagcctttgggagcatgaataagagattttaagatcggttgaaataaaggattaccagctaatttcaagcattgaatcgtgaaattatgagccttttcagcatccatttggaaaatgccgtgacggaataattgatacatactcgtttatctctcgggatagtttactgtaagaaagtgcggtcaattttcaccgcactttaaaggtaaggttggtcgtattctacgaggaacaaaaatgatgtgcaaataataaagaaataattaatggaaaatattgtaaaattaagctctacacgatcattaatacattttaattatgtataaaaaacggctagttttatttttatggtgcctagggtctttctctttatgttgggaattgccattgttcaatctcctgttcaagtgcggttaattcttcgggggggttaaatgtcagtaagcggtcttcaaatgcttgacgttgcccgataatgatgccaatcacgacggcaaactgagcggatttttcaatcactttttctaccaatatttcaaacggcacaccacgatttcgggcaatttgtgtgagcattgaggtttctgttgaattatccgcctgccacgctaacgcttctttctcttggcggtaaaaactttcaatttccgtttgtggatagcctgccagcaatccatttttaggtagattttttggcgtttgtaggttaaatcgccgttagcgtgcatacgaagtgtgccaatctcttggttgcttaatttatattcgaaccaacaatcgccattgtttgccccgatatttaaatagtctccgcgtgaagcataatgcgggctgtctgaaatacggatatttctttttgccacaatacgattttcaaaggttttctcgccattaatgctttcgttaccatttaaaccaacctttccatctgcggtagttttggcttctactgctttgtcataggcggttttcacggcttttgatgttgcagcttcggtttcgctgtcgctgttagtggctgagcttagttgcacgatcccatattgttgtaacgttgcccgtgcaatttcatttaaggcaaattccccatccacgcaataagtcagggaaattatcaacttcgcctcgttttgcagatgatgcaaaaatgctttcatctggcgtatttactaatgccatatatgacctcttatgttaagttgaaaagatattgcacacctgcttggcgtggcaatatatctaaatgattgattgcgaatttcttaaaatcagatgtgctcgcacttggaacagagatagagacggtcatatcgtagttatcgacaatgtgacaaccttctccgaaaataaataggcatgcctcaattaagtttggtagcgtgcctatttggtagtttttaaggattctgcatttaatcaggaaccgataatcatcatcggataatctgacggaatcagacagcgagtctcgtttacgataccattcacaccgcctagtcttttttggctaaatcccagtgcattgggcgaattgcggaaaccaaaaaatttacgtaattgatagccattaataacccgaaattgcccgacgtgtacctacttcgcctgcacgagcaggcgcttgttcgtaagcataactcatttcattattctcctaactgttgtaagttttgttgaaatctatttttggtgcagctttaggctccgcatcaccaagcaaaatattaccgagtgatttacgttcatccgctaatttcgccacaaccacttttgctgtttgatatgcacccgaaatttcctcatcggataatttggctgcctcatctttagtaaaaatgccctgcgcaactaccgcactttcttggatttcacgcacagtcgcgttatccgcaaaattgacttctttaaatgcagttttagcatcagccaacacggcagcttgttttacttctgcgtcacgttttgcttgtgcatcttttagctgttgaatttcttcatctttagctttaaggcttttttcaagctcttctttttccacgtcatcttcctttttattttcaggttcagattttttttcttttggtttggttggttgttcgccttttggctctttaccttcttcactaccagacttttcttcgtcctcaatttgttttttctgttcgtccgacaacttgatgccgaacgcacctaaaaacgcatcgagaatttttgcggttttccccataatggttttatcctcatcggcaagttttacacttccaccgcagcgaccctttgccacaatcgctacgtggttgccgatcatcggcgacatctcaaaatctgcatcttgtaccgtggatggcttaatatcgcagtcatatccgcaagataattgttccacaccgtgctcctgtacggttttaatggcttgttcatcataaatccaagcctcggctgtgagttcatcgcccactcgcttaacattacgcacgacaccgacagaaagctgtttccagtttttcgcattcaccccatctttaagatgaccaacggttaatgttgcattttcaaaactcttaatcgtttcatcgctaaacaaagatttctcggtgcgagcaacttttttaataccgtcttcttttagcccaagttctgtagcgaggtaatcaaataccccaactttagaaatggttgcgggcacaactaaaaaaccatctttagtgatggttctttgtgtgtctgcttgagtagttttgtctgtaaatttcatttatttaccccaataaaaaacccgaccatttctgatcgggttatttgtttttttgcaatatcacgccaacatttggctaattattgtttgtgctacttgttttatcgcatcaagtgataaatcaaggcttttgctttttatcgtagtttttaagctattccagacagtatcgttgcggattttgtctaagagttcatgaccttgccaagtcagcaaccgagcgataagactcatctcatttagagaagaataatctatcgcttcaatcagccctgcactttgcaataacttaaaatgataagatacagtttctgaatcgaaaccagtaaatccatcaggtaataaactccctctagcctctgactgactttccaatttaagcaatatagagcgaattaaatcccaattacgtttcattctttgttatctcttggccaaagcatatccacaatctcatcataagatgatgtttaggctgtttaacatttgaactaatagtggtaaaataagctaaaccgtagattgagcttgggaacgttttggacgtatgcggatgcgagttaataaactaggaattacgcaccaaactattctgcggttatttttttgatttccgcctataaacaacccaatcgaaatgattgggttgtttgaatggctgaatttaatttagagccatcatttgatggtaagcattacgcttgctttctcgcaaggattgtatttctgacttcgtcaggtgtcttacgtgaattaatgatgaatcttgcttcccattctgtaaaccgcgagaagtcgtagccaaattcttttttccaccaactttcaagttcgccatatttactccgtaattctgctaatgtgtgtttagatagccttaattgtacagaatattgtttgccggttaaagcataagatgcaataacttttcctttattatatagccttttagactagccaatgtaccgccttgtgtttgtgtgtcatctaaaataatagcatatttatcttttggaactatgccatcaaaagctggagaataaaccaatcgatgccatccatctcccccagttctagatacttttgttgcttgaacaattgataaatcaacaggaatatggagttttttagataatacagtagcaatagctacaggaatcatattttgaccaacggcttcttctgcatgaacaggaattagaattgcatttttattgccaaccaattgcttcaatttatttaccgcatcatctgtaactaaatctttagcaagttgataagcatcttcaatactaccctttttagcattttcatatagcggatgtgatgttgcatctcctaatttcctatcaatgatagtatcagggaaatcatcagaccattctgagcgcatttgttgtttttcctgttggctaactattgggctatttttcactatctgctcgttattatcaagcactggaatctgaacacaccgacaattaaaatcatgaccaggatgatcagtatcagcaggcggattggcatattcaaatatctgcccatctttttccgcatggctttcgcgtacacgctcatcaagcgatgctgaccacatatatttttttatgccaacctcttcatgtctcgcttgcgttaaggcggcatttaattttgaggactggtctcgcgcaataaacattgctcgtttttcggttgttttacccaagtcttttatttgtgctgcaaggtctttatttaaagaacctcgaaccattgcttgcatgacggcattttgcactttatcaagatattgtgagcgaatagacttaattaactggatattaccagcggtcaatgcattcactttctcagtaatatttggactattgcgtaaataggcggataaatcgatgccagtttgattttttagattggttgatacttcagcatggttttgcgcatcaccacgactaacaaagccattggcgatattttcggcctgtgaagtgcggtctgatttttcgtacttttctaatactttcatcagtgctttcgcactaatcgcttgaaatccttttgcatcatccataaaaaaagagccttgcggttgttgcagggctctttctacatcattggtcatcattttgacgaactgcttaagctgttgtctataccaaagctccgttctcttactcatcttcactggcttgaacttgcgtgctctcgccttctggttcttcaaaatttctggcaagttcattagcatttttcatttcctcaatgtcatcagcagagatattggcaaataaaccactttctcggagttcgtttgctacttgatattcatttactacgccattttgaattaacgtatttgccgctgtagcaaaggtattaagcatattgacttgttgttcttgtttaaccaccgtcaatggtaaaaactcaaaccaccagtcatcaggttgcccaccaaataattcattgcatagcagtgtatcaagcacntcaagcacaggacgcaatcttgtttcttgcaatcgatgaatggattcgtggtagttttgaatatcctcatctccacttgccaatcccgaaacagattgcccaaacaaaatggtgactggcatatctgccgcacctgccaccgcattgcgaaactctgtcaataaatcttttaacccaccaaaagataattcttttcggtcgtactcattttccgcatcaagcaacagactattggttgctgatttaatcgactgcaccgctgaaataacgtgagccacatcattttctaagccagctgaaatcttgtcagataaccctgcaattttgaaaatatcgattttactttcaaaaataaggtcgccgacattcgctgaggcactatcaaagcgtttaagtacatcaataatcttttcaaggtctgatacaccccaaatatcgttatcagataatggcgcatcattggcattgatgattaataagcgtgaatgatgcactgaaacagattgtgtgccgccagtaatggtatattcactgtatcgaccaaagtttggcgaaaatacatcgtcatctcgttgtcctgtcggtgagattttccatttaggtaagataattaatcgttttaatcgttctgtaggctgcaatggcgaagtgatgttaattgtgtcagtgacaaccaataaacccaccgccccatacaaactagaccattgcaacgctttagttaatgtctcacgcagttttaatctacgttcaagcttagtgaactcgtctagctgttcagatttcaagtcattcgagaaaatatcacgccaattacgcaccatatcttccgaacgtttaatacaaaccttatttgcaatccagttatcacgccataatgcttcgatttgcattaagtcatcggttaaactaagcccacgagcataatatgtctggtcttgtttgctacctaactttagcgcaagtgatttgatgccatctaaaatattcatcttataaatccagtagtgatttaggttttgtcggggcgtagcacataactaaagcatccgccatatttggagaaggtatgccacgttttttcatatcctttttgctttcaacctttacccgcccgttattgtcataatcaacacgaggacgtgataattctgctttcaaatactcaagctctttgattttgctcgataggcttatcagttcatcgtcaggataaacatccccatactttactgctcgataggttttatagaatctatctctcaacgcccaccaagattgggctttaatgttcgaaaacatatcttgattcttttttcctttgatatattcacgctcgggataagcaactgcaccaccagcattaaatccttccacttgtaaagattttggcaagcgtttaaagtgagcttttactcccgcccccacgccaatactatcgaatataatcaaatcagctttaaatttgaccgcactttgatttgttcggttggcggaatcaatcacatcgccatttttccaaacttcaatgtcaagcaccacagaaccgtgaacaaatgcattagcgttactatccgcaccctcatcagccacatcaaagccaactttcttcattcctttagcggtaaaaccgagcttgagatgcgcatctaccgcatattcaatccatacaggcttaataatcgccaaatcactgtctgcaacaggctcgccctcataaacgtgacgataaagctcgtaatcacgctcacgcatctgctccatatcttccattaattctttcggaaaatatgggttgtcttgccaattcactaagaccgatttacaccgctcaggcggatgaatcacaaaacgttgataggtgtcatcaagaatattcttcgggttaaagctcacaataatctgcgaaccgtcttcacgaatggttggaatcaatatatcccaactttcttttgaaacattctcgccttcttctacccaaactacatcaatgcctgtcatcgacttaatcgaagtaatgttagttttcagccccgcaaacgtgaagcgtgaaccgttttgcccgataatttgcgttttctgaacatcaaaaaaggcttgcaagctaagcatttcaatctgatctgccaacatctgaatcacagaatcagaaatcgatttctgaatttcacggaacacaaaactcgaacaggcgattgataggctcgcaatactaatgctctagcgatactaaaacttttacctgaacctcgcccaccgtagaaaataataaaccgccaaatagattcaaagagcggtttgaattttgtcggaaattgaatattaagctggctcatcgctaaatgtcacattaatcacagtaggtaagggcttgccatcagttgttacatcaactttattggtaaacatccctaaatgcttcccaagcaattcaagggctttatttgcacctgtcggttcaaaaacgaaacattcggtattaacgctttgtgccgttccttcttgagcattttttaccacagtggtaatagtaagtggctttcttcccatacaaatatcacgatactcttgcaagtccgcaatgatattatctagggtaagattatggcgttgttgatgggcttgtcttagttcttcaacccttaccgtaatcttaccgttcttattaagtaactcacttgccttaacattgataacttcagttgtcatttttgagcaatcataactctgccgatatgcttcactggcattccccagctcaatataaagctggcaaaatttttcttgtttaggtgttaatccacgaccagacgtagattttcctttcacgtctgacataggaaatccttacttaataggcagttcaatctgcatcttatcttcaaaaagttttaaagttgcttctagcacaggcttatcgcccttccattccctcaaccctttaccacataaactcgcaaatgctttcttcgctttatgctcaatgcacaattcgttatatttatgcatcaagctataaccttcttgctgtaatttctcacgcataaaatcaaaggctttaataaactctactttgaatttcattgctttttgggttctatatcccattaccaaaagcaaaaatccatttttagtcatttgatacatgggttgttttctgccccattcatcgaaatatgaggtctcctcaaaattgaggagagcaaactcaccgcaatcttgttcaataactaatgctttgatatcacggatgatgttatcgtgacgtttaccaaacaccgtggcaatatgccgagaatttgtcacaatacgttgcttgtcatttacctttaagaattgttcaaagttttcaattgtttgtaggttcattttggacttccattaaattttagataataaaaaacccgaccatttctgatcgggttatttagtcctaacaaaactacctagaaggcttggtttctaccaatttaaagatgttagacattagtcgtggttatttaccgccttttgcttgattaatccacttattaagatgatctacttggcttgcgcacttatctcgctctgcggttaccttaactaactgtatgactacatcgccgtatgtttccccagtaaatgctgttttgacacaaggtgcagtataggcttgaggcggataaatatattctggtttagtcgtgattttattcgtgcaagcggtcaagaacagactgaggcaaacgagtgtgagcacaaggttgagtcttaatgattgttttaactgattcagcattttctgttgctatcctttctatttcatcattacgctcttgttgtaacgcaagacttaatgatttgttagtatcttcttgttgctttgtcgttatttccaactcatctataacgctagattggtaacgcaatgcaccaaacaaaaccacgacaacacccactaacgctatgtaaatgtacttagtcattatccgttaccattaatgctcgatagagcttgcaacgctcatcaatgccatttagtccaccattaattcttcgcgtgactttttcgacagaattaagctcagccaactcatagcacttccaataccacactgcagttttaacagataaatctaaattccctgccacatcttctggctcaatatctctacctaaccattttctaaatgcggcataattatccttacctgtaatctgaatcagtccacgaccacgatacttccaaccatctccacttttctcatcgccattacccaaacgattagcataaatacgattggctattagctcaggtttgcgctcatatttcttcgctgtaagagggtctgggaaatatttacggaaagtttgagaaagcccaagccaagaataatttaaattttctttaaatcttataaatccgccactttcatgtccacattgagccaaaaacatcgcttgctgcatcttattcacacaacctgctttttctatctgcgccgaaatagcttgataaacacctttaactgcgtgtggaaaaattttattaaatgtcacttcggaaatcatcattgtcatctttttcaattctccgattaatgaatttaaataaaaactcgcgaattttttcagtaccaacaaaaccaatcatcgtaccgagaaatgaagaatattctgtatgcccaaataaatgcgtacaaattggcaccgcaacacccgcaatagaggcacacatagccgcatcaattaaaacataacgaatagctggctttttacgcataaacccaaatcttaaaagagaaataaataacgcccaaaaagcactctgtgctgagctagaactaagatttgtttgcaaccaagaccatattaacgcccacacatcaggctctttaattggcatatattttctcccgcctgttctttaggcaataaaaaagccccgaccgtttccgatcagggctgtaaaattctttcttgcgtttgctatgcgctaaaaccgcaatatagtacatataatacacttttagtgtgcactgtcaagcggtttatgaagtgcgctaattagtgatgacgtgtcgcaaatatacccatcgcaatcttggtttaaattgagttcgtatgctgcccataacaacgccaccgcaaagagaattctgaacataatttatcctttttcgtgaatttgaggtgtaaaaatccgccacacggtaaagtgcggtcggattttccgttgtttttagaagtcgattttgactgcttttggattaaagcctcgcaagtgttttaatacacgccaatttgtcattgggtcgatgttaaactcttgtgtaatacggtttaagatttggtttgttgagcgtagacgcttaaatattcgtaagcctgtccatatatatctccgctcatatttgagcctagcgccttaaaggctttttcgatatgttggaatgtgacgatgccacgcatgaaagcgaaccacaaccaaacaagctgttgaagttcatactcggtaaattcaaaactgaatttcttttcgggttctggcaaggcgagctgttgcggttgaagttgatattttcctgttttacgaatttgcgggagaacttcttcaaatacccacgcctcgaatggttcggcttctggtttacgggatttgatgatcagacggtaaagatttggttcgttgatgaatgtcatttcctgatctgcactttttgtaggggtgtaacgtttcgttacgcccccttgtttgcaatgatcttgtaatgcttttcttgaatttgtatatccgagaatgtggcaaacatccgtaccacaaaaccaaaattcaccttttggatctaaaatcacgcgaacaggaagatctttaaaattaaatgttgagaattgaatttgatttttcattgtgtatttcctttttgagaggattgataatttacccataattgggcgaccaacggctcaaaaccagtacacaatctggcggagttattccctttcggtattgtattcctcgcaccgtcggtcattgattctttgagaattttataatggcggtaaaactctcaaattttagatacaaaaaaatcacgctgacggggtgaatgaattccgttgtgtaaaaggtttttgagaccttgaataaaatagtagaggaaaatttggagaatgtaaagcatgaaaattatattttattgtgaaccatacttgacaccctgcgaaaattatctaaaataacgtcaaagcaatcgataaggattaataatgacaatccaaatcaaaaccactctgacatttgattcttggttaagcaaactaaaaaacttgcgtgccaaagcgaaaataaacgcacgaattaaacgcttacagttcggcaactttggtgatatcaaaagcgtgaatgatgggatttttgaattacggattgatgaaggtcaaggttatcgagtttatcttaaaaaccagaatggcgtattagtgattttactttgtggcggagataaatccacacaagataaagatattaaacaagcaaaacttctcgcacaggagctaggattatgactgaacaattaaaagactttgatgtggcagaacacctcacttctgaagaagaaattcaactttaccttaatgaaattctacaagaagataatattgagcttattttatccgcccttggcgacatagcccgtgcgcgtaacatgagccaaatcgcacgtgatgcaggaataagccgagaaggtctttataaagccttatctggcacgggcaatcctacttttgctactgtaatgaaagtaatgaaagccttaaatttacaattccaagtgcaacaatctcgattcgcctaaaagaaatgcggtcaaaatcgaccgcacttttcaggcaataaataaatattgcttgccttctgttgataatagcaataaaagtgatgtttttaccgttttcaatcgattgaaatattcacgccgtgaaatatgtaaatatcgccaaattccttgtttttcccatctcttgatataagtcagaacgaatacatcataaagttctggtgtgacttttctaattacaccaaggtagccatcaatttccatgcctaattcatcgcttataggacgcatacgatatttttcagcataacgagcatcacatttcatctctgcaaaccctgcggctacacgtggaaattcagtctcgaaagatccgccgttttgctctaagtacggtactgcgaatcctattcagttcatcaccaactattcgcagtggttcgtgatgagttttaaaacttaacttagaatacatcacaatgacacacttaaacttaattcctgtttttaatggcttaatccaaaatcaacccgttcaactttgcaacgctcgtgaacttcacgcattcgtagaaagcaaacagcaatacactgattggatcaaaaaccgcatcaacgaatatggcttcatccaagatgaagactacctcgtcattaccgaacgcaccaacggacgcccacgcaaggaatatcacatcaccctcgatatgggcaaagaactcggtatggtcgaaagaaacgaacgaggcagacaaatccgccaatatttcatccgttgcgaaagaacattaaaagccttgcaacaaccgcaacaacttgccttgccagaacctgagaaattcacgcacgaattcaccgaatttgaaatagaaacgctcgtttggctccttatcggacatcaccaaatgaacaccctactcggacaactcgaaaagccacttgacgccatcggcagcaatctacaccccgctgtgtacagctactggaaagaatatggccgccaatacaaagatgcactcccaaccattaaacgcttaatggcacccttcaaataatcaaaccgtttgaattgggcacgtgcacaacaccttataaaccaataaaacaccacaaaatccgaccgcactttttttactgcggcggattatcacacttaaaatccgataaaaggaacagaaaatgaacaaattaatcattacgctcgtgtgtgcatttgtagtgtatatggtgcacgccctaaatcttaatcaagactgtgacggcaaaatctgtcacaccgaacagacacaacaatattaacaaaccaccgctcttatgggcggttttttattggaggaaatatggaatcaattaaactttcgcagaaagccgaagaagaaattgtgaatgcggcaagaatggcagcgttatccaatttgactgaaaaaagccaaaatttaattacgcttgaggatatcgcaatatattttgggcgacactatcaaaccgttgccaagattatttcaaaactgcctaatttcccaaaacccgttacacccgttacagtcgatcaacaaaattctcgcccacgctatatcgcaggcgaagttgttcgttgggggcggatcaatgctaaaccgtattagctaatcaagtaattccgccacctccgccatatcaggggcataatagacattttgtaaaatcgaaatatctttatgcccagatattttggctaatgtcatcacatctacttttttagatagcctagttaatgcctcacgccgcgtatcgtggaaatgcaaatattctcgctcggcaagttttttgagttttcggaatgttgcatcaagcacactagacttaatatcaaaacacaatccagcatcccctatctcgacttttaaccgttctaaaatagcgattgcatttttagtcaatggcacggttcttgatgtaccgttttttgtcataggcaaaaatgcagtacgtttctcaaaatttacattaccccaactaagactacaaatcttccctgctctcattgcggtttcaacagcaaacaatattgccgcagccgttctcgcttttgcagttttgagcgtatcaacatattcactgatagccacaatagcattaatattttcttccgttactcgctgagttcgaggtttccctttttcgggtaattgtatgccgaccatagggcttttttgtatatacccccatcgctcaagggcaattttgaatatatgacctatcgtagataattcacggcgcacactttcactttttactgattccaatcgctccgcaatccaatcctcaatatctctccgactaacatcagatatatatttatccgtaactggatggcgcaaaaagcgattcagccgattaaattcgtgcttttctccacgctttgttggcgtaattttgttcaaataccgcttaataacatcagaaaataatgtatcaggttgcaatccttgtgcttgcaattctattttcttttcctcttccgcaccccatttcatgttgcattggcgtaatcgatgcataaaaatacttaaaaaatggcaatatttgaggttggaattaatgaggggtttatggctgatgtgaacgtaacgtattgattttactggttgaaatgcataaaagaaaaaaacctgaccaacggtcaagggtttgtatgtggtgcctagggtcggactcgaaccgacacgtttattcaacggcggattttgaatccgctgcgtctaccaatttcgccacccaggcttaatggggttgaattatacgtatatataacaatgtgacaagcaaaatttattggaaataattcatttgttttaaaaataagcaagaattttctgttttctaaaaatatcgccaaacaaatgcaataattaaaatgcacaacataattaaaatttgagctaaacgtttttttgttaatttttcagctgccataatgctttactcttcttaatctgactaaactaattagtggtagaatatttgcgttagatcaattttacactatttttttcaatatttgaggcgtacatgaaaaatttcgttgcaggagctcaatcagggcgcaaaattcaatcaggcggttgtgcgattcattgtcaggattgcagtattagtcagctttgtattccttttaccttaaatgaacaagaattagatcagcttgataatatcatagagagaaaaaaaccgattcaaaagtctcaagtattatttaaagcaggagattctctcaattcaatttatgctattcgttctggcacaataaaaagctatacgattagtgaatctggcgaagaacaaattacttcatttcatttgcccggtgacctagttggttttgatgccattactcaaatgcaacaccctagttttgcacaagctctagaaacggctatggtatgtgaaattccttttgatattttagatgatttggcaggaaaaatgccaaaactacgccagcaaattttacgtttgatgagcagtgaaattaaaagtgatcaagagatgattttattgctatctaaaatgaatgcagaagaacgtttggctgcttttattcataatctttctaaacgctattctgctcgaggtttttcagcaagagaatttcgtttaacaatgacacgtggcgatattggtaattatctaggtttaacagtagaaaccatcagccgcttattaggccgctttcaaaaactcggcgtgattagcgtacaaggcaaatatattacaatcaatgatttaaatggtttaattgaattaactggtacgaataaaacaaaaattacattagttaaataaatttaagcgtgaatatcacgcctttttgtgcttgataaaaataaatttatccaaattaatcttgtaccttgccatttttgctattcttttttatcctatgcctcaattttggaggctattatgaaatttaaaaatattctcgttgtacttaatcccagtaatgaaaaacagtacgccctagctcgtgcagtgcgtttagttgaagaacaaaaaaatgaaactaaggtaaaaatcaccgcacttttatcagtctatgatttatcttatgaaatgtcagctttactttcttccgaagaacgttcagaaatgcatcaacaagtaattgaaaaacaccgtcacgctgttcaatattacttagataaatatgcaaatccagaaattgaattacaatctcatattgtgtggaatagcaatgaagctgatgcaattaacgaagaagtagaaaataataattacgatctcgtcgtaaaatataccaaagacgaagaaaaacttacgtctctaatctttactcccattgattggcaacttcttcgtaaatgccctattcctgtcttaatggttcgtgatggcgattggaaacatccacgccgtattcttgtggctgttaatgtatctggagagcaagaatatcaagatgaatttaatcaagagctggtagaaactggtatttcactcgcggaaaatctaaatcgtggtaatgtccatttggtggcagcctacccttccgcgccaatcaatatggcgattgatttgcctgaatttaatacttcaggttatgaaaacggtattcgaggtcagcatctcattaatatgaaagcgttacgtcagaagtttgggattgatgaagatcatactcacgtacgcgaaggtttcccagaggaagttattcctgaagtggcgaaagaaattgaagctgaattagtgattttaggcacagtgggacgcacaggtttatctgccgcattattaggcaatactgcagnacatgtaattagtaaattaagttgtaatttattaggcattaaaccatcgaaaaaagacgattaaaacattttcctcaatttataagacgccctaaatattttgtatttagggcgtttttatactatttcttatggtatttttcattttgtgatctcgatcacaaatcttaaaattttatttaaatagctatttaaatgatagctattttcatttagtattttgcactcattttttaactcccccattcttattaaggaaatatatgaaaaagacattaattacaagcttattggttttatctggcatagcacaagctcacgaagtttgggttcaagcaccgacgaaattagcatcaggttctgtattaaaagcagaattagcttatggggattacccttatgtagaaaaaattcctgaagcacgcttaaaaatttttgcgccaatggaaattattcatcaaaatggagaaaaacaaaccttaatccaaaaaggcgaaaactatcaatatcaatcagagaaagcactgtctgatggttcttattgggtaacagccacttataaaccaacattttggtcacaaaatgctgaaggttggaaaatggataatttgaaaggattagaaaacccaacttattgcgaacaaactcaaatgtttggcaaaagtctcgttaccgttggtaaaaaaccattaaatgcagaaatggcaatgacaagagttggtttaccgctagaaattgttcctttgcgtgatccaagcaaagcgaaatcaggcgaaccgttccctgttcaaattttctaccaagatcagccattagcaggcgaaactgtcattgcaacagctgatactattatcgtgaaagatcttgaagcaagtacaggtcatcgtgaaccacaaggtttttcaggtaaaacagatagtcaaggacgtgtgaatatcattccattaattgatggaatttggaaaattaaagttattcataaaacaccatttgcagatcaacaaatttgtcagcaatctgcaagctatagcacattaattttaccggttggtaaaggattagctaaactacctccaaaaccagaacaccatcatcactaattttaaaagtgcggtaaaatttcaccgcactttttacatcctaattaaataaaaaatacagaaatagtctgtctaaattctaagttattcatttgcatatccagattttggcagagctttcccatctaaatatgccaaattatctttaagtcttaaccgcccttcggtaaaccatttaatcacaagcggataaatttgatattcttgctcacgggttctagcctccacttcttcgatgctatcttcagggaagattggcacttttgcttgtaagacaatcgcaccaccatctacttcttcattgacaaaatgaacggttgtgccgtgttcattgtcgcctgcttcaatcgcacgttggtaggtgtttaagcctgcgtatttaggaagaagagaaggatggatatttaaaattttccctgcaaaacgttgggtaaattttggggtaagaattttcatataaccagcaaggacgatcaaatctacagctaggctttgcaaataatcgccaattgcgtcgtccatttcaaggttattggaaaaatttttgcgaagaaagaccgcttgcggaatctgtgcttgtttggctcgaactaagccgtaagcatctgctttgttacttatcacacaagcaattttggcgggaatatcgcctgaatggcaggcatcaataatagtttgtaaatttgttccttgaccagaaataaggacggcaatttttttcattttcttccttatagaaatcagcccaaaagggctgaatttaaatttaagattttattattgaatctcaacctgtgcctcgctttcgccaagatgttcaattttgccgataacccacgctttttcgcccgattgttcaagcaatgcaagagcggtttcaacctctttttctggtaatgcaattaccatacctacgccacagttaaaggtgcgatacatttcataacggctgatattgcctttttcttgtaaccagttgaagatcgcaggccattgccagcttgattcatcaatcactgctttagtattgtcaggtaatacacgcgggatattttcccagaaaccaccacctgttaagtgagcaatggcgtgaacttcggtctgcttgatcaactgtaaaatcgattttacatagattttggttggggctaaaagatgctcgctaagcggtttgccttctaataaatccgttggatttgcaccacttacttcaagcactttgcgaattaacgaataaccgtttgagtgtgcaccgcttgagccgagtgcgataagcgtgtcgcctgttttcactgctgtgccgtcaataatctctgatttttcaaccacgcctacgcagaaacccgccaaatcatagtccccttcgtgatacattcctggcatttcggcggtttcgccacccactaacgcacagccagacatttcacaaccatctgcaatacctttgatcacacttgctgccacatcaacgtctaatttccctgtagcatagtaatctaagaagaaaagcggttctgccccttgtacgattaagtcgtttacacacattgccactaaatcttgaccgatggtatcgtgttttttcaagtcaatcgcaagtcgtaattttgtgccaacgccatctgtaccagaaactaaaattggctctttatatttggtgggtaaagcacataatgcgccgaaaccacccaatccgcccataacttcagagcggcgagtgcgttttacatcgcctttgatacgttcgactaattcatttccagtgtgaatatcgacgccagcatctttatagctcagttgtgtgttgctcacgattaacctcgatcaattgaaataaaaattgggcagattatatcatcaagcaaacgtttgcgatattgttaaattaattcatttaatgacatttttaaaattaaaatgaaattgcttgcaatcaaaatttatttgtactactttaatagtacaaataagctcaagatttaggagaaaaaatgaaaactactactgcattagtaacaggtgcaaccgcaggctttggcttggcaatctgtaaaaaattgatcgaagcaggctataaagtgattggcacgggcagacgtgcagatcgattagcagaaatccattcacaattgggcaataattttctaccgcttgcctttgacattcgtgatgaacaagccacaattaacgctctaaatacccttcctgaaggctggcaagcggtcgatttattagtgaataatgcaggtttagccttgggattagagccggcacataaagcggatttacaagattggtatcagatgattgataccaacatcaaaggattggttactatcactcgccttgtgttgccaaatatggtggctcgtaattacgggcagattatcaatttgagttcaattgcaggtacttatccttatgcaggcagtaatgtatatggtggaactaaagcttttgtcacacaatttagcttaaatttacgagccgatctggcaggcacaaaaattcgagtaagcaatgttgaaccgggtttatgtggcggtacggagttctctaatgtgcgttttcacggcgatgatgaaagagccgcaaaagtctatgaaaacgtgcaatcggttcagcctgaagatattgcgaacattgtattatggcttcatcaacaacctgaacacgtgaacattaatcgtattgaagtaatgccaaccgctcaatcttttgcaggaatgagcgtttcaaaagaaaaataaaataataggaaaaaatatgtcagacacacttcttaacccttattttggcgaatttggcggaatgtatgtacccgaaattttagtgcctgttttaaagcaattagaacaagcctttgtggaggctcaaaatgatcctacattccaagcagaatttgctgatttactcaaaaattatgcgggcagaccgaccgcacttactctttgtcgtaacttaaccaaaggtacaaaaactaaactttatcttaaacgtgaagatttattacacggtggtgcacacaaaacaaaccaagtgttagggcaaattttattggctaaacgtatgggcaaaacgcgtattattgccgaaacaggtgcagggcaacacggcgtggcaacagccctagcttgtgctatgttagatatgccgtgccgtgtttatatgggggcaaaagatgttgagcgtcaatcaccaaacgtgttccgtatgcgtttaatgggcgcggaagtgattcctgtacaaaaaggctcttgttctttaaaagatgcctgttgtgaagcgatgcgtgattggtcagcaaattatgaaaccacccattatttacttggaaccgctgcaggccctcaccccttcccgacgattgtgagagaatttcaaaaaatgattggcgaagaaaccaaacgtcaaattctcgaacgggaaggtcgtttacctgatacagtcattgctgctgttggcggtggctcgaatgcaattggtatgtttgctgattttattgatgaatcaaatgtgcgtttaattggtgttgagcctgcgggtaaaggtattgaaacgggcgaacacggtgcaccgctcaagcacggcacaacaggcatctacttcggaatgaaatcgccaattatgcaagataaagatggacaaattgaggaatcctattccatttctgcagggttagattttccctctgtcgggccgcaacatgcttatttaaatgagattggtcgtgctgattatgtatcgattaccgatgaagaagctctcaacgcattccaagaattggcaaaacatgaaggcattatccctgcattagaaagctcacacgccttggcttatgccttgaaattgattaaacaaaatcctgaaaaagaacaacttttagtggttaatctttcaggacgaggcgataaagatatttttaccgttgataaaattttaaatggaggagcaaactaatgagccgttttgaaacgcaatttgcgacacttaacgcaaaaaatgaaggggccttcgtgccgttcgttaccctttgcgaccctactttcgaccgctcttttgagatcatttgcacacttgtggataacggtgcagatgctttagaactcggttttcctttttccgatccgctactcgatggcccagttattcaagccgcgaataatcgtgctttaactgcaggtcatagcagcgaagatagcttgaaactattggaaaaagtgcggtcaaaatatccagagattccgattagcttattactttgtgccaatttaatttttgctaaaggtttagatgctttttatcaacgttgtgcagaagttggtgttgatgctgtacttgtagcagatattccgttactggcaaaaggagattatgtacaaacagctaaaaaacacggtattcaacccgtctttatttgcccaccaaatgcggacgagaaaacgatccaaggcgtagcgaaaaatagcgaaggctatacctatttagtctcacgtgcaggcgtaaccagtgctgaaaatcaagctcacgcagcaaatttagatacccttgtagaaaagcttaaagcccacaatgccccaccaattttacaaggcttcggcattgctcaaccagagcaagttaaagaagcgttgtctttgggcactgcgggtgcaatttcaggttcggcaacggtgaaaattattgagcgaaatttagataatcacgagcaatgtttagctgaattagctgaatttgttcaaacgatgaaagctgcaacaaaataagcaaaaaagaacccgcacttgtggcgggtttcttttatcgagaaaattaaaaatttaatactttcagcttccatccaccataaggggctgaatggattataaatagaatattttgcatgttattctccttaatttcattaataaccttgctgataaattccttccaacaatttcactgaaagtaaggcgagattaaagcgttgttcatctgccacagaccaaaattctacgccattttctaccgcacttatttgacttaaatgaagttttactgattcttcgccattttcttgttctccattaagcacaggcgtaattaaggtttcttctaaagcgataagctcgctattttgaggctgatagtcgaaatcataatctgaaagtgcggtgactttttgtgccaatccataaaatacaggtacttggattgcatgaaatgtagcacgatctaattgcggaaaaattcgttgtaattgattcgataaattaggtgtttgatacggataaacatcaaaggctaagcgcgtttcttcttcatccaatggaataccatttaataaacgggctgtttgtcccgcaagtttagtcacggtttccgcatccgtataagaagccggcaataaagaggtgacaaacacttgattaagattcgtttcttgtaaaatcggggcaagcgttaaagcaagttggcttacttgtggatcaggcaagctaacaatgttacgttgtctcaattcaagtaattgtgattcatttaccgttggaacaacaacaggcacatccgaaagtgcactgcaaacgcctaacatatcaatgacaatacagccctgctctgctgcttgcgcaatatgggaaacttgctcaagttttcctgcaaaaaagacataattaaaatcagcccactctacttcatttggcgaaagttgttcaacgcctttatttcgaaaacgaatattttgttcttcttcaaaaggtattatttcaacaatagaaactttgctaatttcaagcgcactttgttctaaacgctctacaattttttcacttaattcaaattctgctgctatcgcaatatttaaggttgcgtccatttttctctccgctgtaaaataatcagcattattttacaccaaaaccaggaacgaaataatgacacccgcaattgatttacttaaaaaacaaaaaattccttttatcttgcacacttatgatcatgatccgaataatcaacattttggtgatgaggcagccgaaaaattaggcattgatcctaaccgctcttttaaaaccttacttgtggcggaaaatggcgatcagaaaaaacttgcttgttttgtgcttgcaacggccaatatgctgaatttaaagaaagcagcaaaatctatcggtgtgaaaaaagtggaaatggcggataaagatgcagcacaaaaaagtacaggctatcttgtaggtggaattagcccgctaggtcaaaagaaacgcgtgaaaaccgtgataaaatcaaccgcacttgagtttgaaacgatttatgtttcaggcggaaaacgtgggctaagcgtagaaattgcgccacaagatttagcnaaagtattaggtgcagaatttactgatattgttgatgaataagtgatggacttataaatttaaaggcggatttattatttaatacgaactaaaaggactaagctttttttaatcacaaagcttagtccnttactgactttctaacttttaattcttgtcttttaagttaggattaatagnaaaaatttagggtatttattattcttgagtatccgcaattgggattatttttgtggcgtgagatcctttatcgctgtggagaacttcaaattgtactttttgacccgcttttaatgaacgatagccgtccatttcaatcactgaataatgtgcaaaaatatcggcatctacaccttctgcggaaatgaaaccaaatccttttgcattattgaaccattttacaataccaatttccatnaaagncctctctaggcttcggcctattaamacaataaatcaacaagactctcgccttattacctactaattaggttcgctatgtttaaatattktgarcggttatgcaacgagcaatattcaaaaatgataagtagatcacaaaaaatttaattttctggagtttttttatcatttttatgaatttctcgtagtgctttcgccactatttgaatcgcttctccactactaattccttktgccataagttcttgaatttgctcaactgctttttgttgctgttcgtgtgttaagttaatatcaaacattttcccatccaaattgattcattaattgctgccattgttcatctaaacctgctgtaattgttatttgctctttcgttattggatgaataaaagacaaactatcagaatgtaaaaataatcgagaacaacctaaatgtgacattaatgcacgattttgatgtaagtcaccatattgcgtatcccctmaaattgggtgaaaaacatgtttcatatgscgacgtaaktggtgttttctgccctgtatgagggattaatttaactaaagaataacgcgccgtttgataacgcccagcaggataaggcatttcgactatttttaatccttcataatcagtaatcgcttcttgaggctctttatcttcttgagaaaatttatctgcgattttatccaattgaatttttagtggataatctatccgctcttttccctgtagatacccacgcactacagccaaataagatttctgaacgtacttttgttcaaactgttcacacattaaattcgcaatttcactgctcaatgcaaataacaacacgccagatgtcggtcgatctaaacgatgaataggaaatacgtgctgaccaatctgatctcgtaaagtttgcatcacaaattgagtttcgtgaggatctaaccaactgcgatgaaccagcatacctgcaggcttattcaccgcaacgagaaacccatcttgatataaaatttctagcattcgttattgttcamaagttcttctaaagcaactaaaggagttaatagttgttgtaactcattaaattccttcattgcttcttcaatataaggagaaatagcaattttatttggcaaggctganccactttctaacaatgcctgcatgcgtggaataaatacccactgtagccactcttcggcagacatcgtatcaattgaaaaaggttcttcacttaaaaacgcctctgcagcagggggcatcgtttgccataaattaagctgctgcatggtaatttgaagctgttcaagatgctgtttagtttgattacgcatattttatatcctaattaatgaatgttttttgcaaatacacgcacatttgaaaaaccattttctttcaaatataaggcttgtaatttactcatcacaccacgttcacaatacaacacgtaacttttactttgatcaaggctaccaaattgagaagaaagtttgtagaacggcatttgaatgacgtcatgtgtacctgattcaaatggcttttcatccgtttcttctgggctacgaatatccaaaatcacttcattttcacctaacacagaaattgcctcgacttccacgactgcttttnctgtttcttctgcaatctggcgaatatctaaatattttgcattttgtaccgcactttcaagaatctcaaaattaaaatgcccttcttctttaagaatcttttcacgaaccgctttaatcgtaggattttttgaaatcacgccacaaaattctggcatagattttgcaatatcatcagtgccaatttctttcgccatcgcgataatttgttctttatcatgggtaattaacggacgcaatactaaggcatcagcggcttcatcaatcaagcgtaaattggttaaagtttggctagaaacttgccctaatgcctcccctgtcacaattgcttcaatattgaaacgttgagcgactttacttgcggctcgcaccatcatccgttttaatacaacgcccatttggccgttatcgactttctctaaaatctcaccaacaactccctcaaagtttaatcgcaataaagcgtactttatgtgaagagctatagcgttgccaaatatgataagccatttgtttaacgccaatttcatggactgtgccaccaagattaaagaaacaataatgaactcgggaaccacgacgaatcaacatataactcgatacgcctgaatcaaatccccccgaaattaaagaaagcacatcctcttgagtcccaatcggataaccgccaatcccagcgtgacgtgctttaactaacatcattttgtcatcttcaatatcaatacgaacagttacatctggatttttcaaccgcacttttgcgctttcaatatattgatttaatccaccgccgatataacgttctgcttcaattgaactaaatttatgttttcctttacgttttactcgaacgcaaaaggttttgtcttgaagttgttgtgcgacatcagcaagcgtcaattcaaaaatatgatgtaaatcggtaaatggtttttcttcaacttctaaaaaatgatgaataccaggaatacgttgtaacaaggcgattaattcttcacgattttcttcattttttgaccgcacttcaatgtaatcccagtggcgtacaactgcggtttcttcatcatatttctgtaaaatattgcggatattagaggttaaaatttttgcgaaacgtttacgcacagtttcgctcttaatcatgatttcaggaaaaagtttaacgataaatttcatataaatagcttaggtatttcttggggatttaaagtggcgagtattttacgcaaagatagtgaaaagtccactggtcctagcttgaaataattttttaacaactcaagtaaaatacagtacaatggcaaacaatttttaccgtgaataaaggataattccatggcgcgtaaacccgcatcttcacaagattttgaaacaacgttagtgcagttagaaaatattgttacacatttagaaaatggcgatctaccgttagaagaagcgttaaaagaatttgaacaaggtgtgcaattagctaagttagggcaagaacgtttacaacaagcagaacaacgtattcagatcttattgcaaaaaacagaagacgcgccactgaatgattataaagggaatgattatgaagggaatgcttaatgggtcacttttctgaagaattacaacaggttcaaactcgtatcaatcgctttttagaagctcaatttgaaggcattgaaagtcataatgcgcctttgcttgaggcgatgaaatacgcattattacttggcggtaagcgagttcgccctttcttagtttacgcaacaggtcaaatgcttggcgcagagaaacaaaccttagattacgctgctgctgccattgaagccattcacgcctattccttaattcacgatgatttacctgcaatggatgatgacaatttacgccgtggacatcctacttgtcatatccaatttgatgaagctacagctattcttgcgggcgatgcactgcaaagtttcgcatttgaaatattaaccaaaacaccgaatatttctactgaacaaaaactggctttaattcaaattttagcgcaaggcgctggtgtgcaaggaatgtgtttagggcaaagtttagatcttatttctgagcataaacagattagtttaagtgaattagaattaattcatcgtaacaaaacgggtgcattgctaattgccgcattgaaattaggtttcatttgttctccgcattttaccgacaaaaggttagaacaatccttaacacaatatgcggaagccattggtttagcctttcaagttcaagacgatattttagatattgaaggcgatagtgcagaaattggcaaacaggtgggtgccgatcttgatttagataaaagtacatatccaaaattacttggattaagtggtgcaaaacaaaaagcgcaagatctatatcaaagtgcgttgtctgaattagaaaaaattccttttgatacaaccgttcgtgcattagctgaattcattattaccagaaaaagttaaatacccacaaaagtgcggtcaaaatttatcacgtttttaaaatgactaacaatatgaacaattatcctcttttatctttaattaattctccagaagatttgcgtcttttaaataaagatcagctaccacaactctgtcaagaattacgtgcttatcttttagaatctgttagtcaaactagcggacatttagcgtcaggtttaggcactgtagagctaaccgttgcgctgcattatgtatataagacgccatttgatcagttaatttgggatgtgggacatcaagcttatccacataaaatcctaacgggtcgccgagagcaaatgtccacaattcgccaaaaagacggtattcatccttttccttggcgtgaagaaagtgaatttgatgtattaagtgttggtcactcctctacgtctattagtgcgggattaggcattgccgttgccgcagaacgagaaaatgcaggtagaaaaacagtatgcgtaatcggtgatggcgcaattactgcgggaatggcatttgaggcattaaatcacgcgggggcattgcatacagatatgttagttattttaaatgataacgaaatgtctatttcagaaaacgttggtgcattaaataatcatcttgcgcgtattttctctggctctctttactctacgcttcgtgatggcagtaaaaaaatccttgataaagttcctccaatcaaaaattttatgaaaaaaaccgaagaacatatgaaaggtgtaatgttttcgccagaaagtacattatttgaagaactcggttttaactatattggcccagtggatgggcataacattgatgaattagtggctacgcttacgaatatgcgtaatctgaaaggcccacaatttttgcatataaaaacgaaaaaaggtaaaggatacgcacccgcagaaaaagatccgattggtttccacggtgtacctaaatttgatccaatcagtggcgaattgcccaaaaacaatagtaaaccaacttattcgaaaatttttggcgattggctatgtgaaatggcagaaaaagatgccaaaattataggtatcacacctgcaatgcgtgagggttcaggtatggtagaattttcccaacgcttcccaaaacaatattttgacgtagcgattgcagaacagcacgctgtcacgtttgccacaggacttgcaattggcggatataaacctgtcgtcgcaatttactcgacatttttacaacgtgcttacgatcaattaattcacgatgttgccattcaaaatctccctgtgctatttgcaattgatcgagcagggatagttggtgcagatggggctacacatcaaggtgcattcgatattagctttatgcgttgcattccaaatatgatcattatgacgccgagtgatgaaaatgaatgccgtcaaatgctctatacaggttatcaatgtggaaaacctgcggcagtgcgctaccctcgcggaaatgccgttggtgtaaaacttactcctttagaaatgcttcctattggtaaatcacgtttaattcgaaaaggtcaaaaaattgcgattttaaattttggtactctattaccatccgctttagagttatcagaaaaactcaatgcaacggttgtcgatatgcgttttgtgaaaccgattgatattgaaatgattaatgtgcttgcacaaactcacgattatttggtcacattggaagaaaatgcaattcaaggtggagcgggatctgctgttgcggaagtactaaattcatcaggaaaatcaaccgcacttttacaacttggcttgccagattattttattccacaagcgacacagcaagaagcattggcagatttaggattggatacaaaaggcattgaagnaaaaattctcaactttattgcaaaacaaggtaatttataaaaataaacgcgatgataatttcatcgcgttttttcttaatccacaattcttaaatgggaaactgattttgttttctttttttcttctcgttttttaggcttatctactgcttcataaaaacctgttggttgttcagtatctggctcaatgttaagttcatcataaatttcctcaggttcaaacatcacgccatcgccattctcacgagcatagatcgcaagggctgcgcccattggaatatacagttcacgagagacgcctttaaaacgcgcattaaactggatgaaatcatttgtaagttgtaaattgcccgtagcactggcagacaagtttaatacaatctgtccatcttttacatattcgacaggaacattcacacctaagtaagtcgcatcaacaactaaataaggcgtaaaactattatctactagccaatcataataggcgcgtaataaataagggcgtttaggagaagatttatattccattatttatcatccattaaattttttggtgcagcttcacctacagattgcaaaaaagaatcacgtgtaaacacacgttccatataagctttaatcgctttacttcctgtgcctgtaaattccacacctaaatgttttaatttccataataatggtgcaacatagcaatcaaccaaaccaaattcttcattcataaaataaggcatctgttgaaaaattggtgcaatccctaatagttcttcttttaactgttttaatgctgaagttttttctttttctgtgccattttctgcttttgcaagggttggataccaatcttgttcaatacgtaacattaaaagtcgatctttagcacgagaaacaggatacacttgcattaatggaggatgtggaaaacgttcatcaagatattccattatgatgcgtgaattaaataatacgagatcacgatcaaccaacgtaggcacagtgccgtatggatttaattccattaaatcttctggtagagcttgcaaatcaacttctgcgttttcataaagcacacctttttctgccaaaacaatttttacctgatggcaataaatatcatctttatttgaaaaaagggtcattactgaacgtttacttgatgcgctggacatttattcctccgaagatccaaaaatattctaggtttttaaggggcaacattttaccataaagcattacctatttgccaatataatcttttttattgttttataatcaataagttagagtaactcaaataataaaaaagcagagatttctctctgcttttcttttggaaacgaaaataaaaattaacgttttgagtattgtggacgacgacgtgctttgtgtaaacccacttttttacgttcaacgcgacgtgcgtcacgagtaacgaaaccagctgcacgaagtgctgggcgtaatgtttcatcgtattccattaatgcacgagtgataccgtgacggattgcacccgcttgaccagaaataccaccacctttaactgtgatgtataaatctaacttatcagttaawtcaaccaactctaatggctgacgtactaccatacgtgctgtttcgcgaccaaagtaaacatctaattcacgttggttgatagtgattttaccactgcccggtttgataaatacacgagctgaagagcttttgcggcggcctgtgccgtagttttgattctctgccattttctaaacctcgtgattaaatatctaatacttgtggttgttgtgctgcgtgttggtgttctccacctgcatacacttttaatttacggaacattgcacggcctaatggaccttttggcaacatacctttaaccgcaatttcaatcactgcttcaggacggcgagcgatcatttctttgaaagtcgcttgtttaataccacctacatagccagtgtgccagtagtaaagtttatctgtttctttacgaccagttactgccactttgtctgckttgataacgatgatgtaatcaccagtatctacgtgtggagtgtactcagccttgtgtttaccacgaagacgacgtgctaattcagtcgctaaacgacctaaagttttacctgtcgcatctactacgtaccagtcgcgtttaaccgtttctggttttgctacaaaagttttcattaattaattaccaaaaattagtttgatacccagtgttcttatgaacacaaccattaatcttaatcgccaccccttcgagtgcgatctcgataaaataatgtacgatgggaattcgcacatttacagggtcggcgtattatactcgttttttcataaaatgctaattttttgcgctaaaaaacaaatctattgtatttatttaacacgcatttatctttctataaaaatacacaaaaaattaccgcactttctttttcgttgtaaaatggggtaaatcattgctaacaaaagtgcggtagttttgagtatgtgttgatctaaaaattagttattattgaacaataattatccatttattgaattattaataataatcatacttttaatgaataaattgaaattgactcatattaaaacctattttattgtacaaatactattttagaatcctaaaggaagccttatgagctacgcgaaagaaattgatacattaaatcaacatattgcagattttaataaaaaaattaatgtctcctttgaattttttccacctaaaaacgaaaaaatggaaacccttctatgggattcaattcatcgtttaaaagtattaaagcctaaatttgtgtcagtcacttacggtgcaaattcgggagaacgtgaccgcactcacggcattgtgaaagccattaaacaagaaactggcttagaagccgcaccacatttaactggaattgatgccacacctgaagaattaaaacaaattgcgagagattattgggatagtggtattcgccgtattgttgcgttacgcggtgacgaacctaaaggttacgcgaaaaaaccattttatgcgtcagatcttgtggaattactccgttctgtcgctgattttgatatttctgtagccgcttatcccgaagttcatccagaagcaaaatccgcacaagcagacttaattaatttaaaacgtaaaattgatgcaggtgcaaaccacgtcattacacaattttnctttgatattgaaaactacctacgttttcgtgatcgttgtgcatcaattggtattgatactgaaatcgtacccggtattttacctgtnactaattttaaacaactccaaaaaatggcatcattcactaatgtgaaaattccagcgtggttagttaaagcctatgatggtttggataatgatccaactacacgtaatcttgtggcagcaagtgttgcaatggatatggtaaaaattttatctcgcgaaggcgtgaatgacttccacttttatacattaaatcgtagtgaattaacttatgctatctgtcatatgttaggtgtaagaccttaattatcacaataatatattncttttcaaacacaaaataagggcgatatttcgcccttatacaaaactaaaaaaattcaaccgcactttattattttatgaactctgtttgcatatacattaatcgatctatattcgttaaataatgccctaattcttgttcttcgggtttatgtaaataaggaattttacctaaaagcggcgcatcaatatgttcaacaagtaaatcaacaatttctgcataatggcttaataatggattaattcgatttgctatccaacctaataacggcacacctaactgttggataacctttaccgtcaataaagcgtgatttacgcaaccatctttaattccaactacaagtactactggcattttttgttgagcaatccaatcagcaaaactttttccttctgccattggtgtcattaaaccaaaagatccttccaccacaacagattgataagtttgattcaaacgcgttaaatcacaattaattttatctaatttaatccgcattttatcttgtgtgagcatgggtgcacagtggctaaaagtataactattaatatcctgataagacacattttcttttgttgaatgcatcagcgttaatacatcagcatttacgaaatgatcataatcagatgtattttctgattgcgcgacaggataaatactctcttctccacaacaagcaataggtttatagccgacaacttgcactccctgcccttgcaaggcttgaatcattgcgcgcgctgctgttgttttccctacattcgtatctgtccctgcgacaaaaaagctactcatttttttctcctttaaaaagtgcggtggattttaaaggaattttttatttaataatttgagataacgcaaattttcactttttttatcttataaatagacaaattatttgatctcactcaagctattaaataaaccatcatcttgttttgctatttgtaagtaaaatccttggcgtttaattgtttccaatacttcattacaatctacattgtgtagtgctttacgcccaagcagattaaacatcatcactaattctggtttaccaaaatgttcgagtaaaacgctgggcactgaagaaaaatcctctctattggcaacataaaggtaacttcctaacttctttttacttttataaatggcacatagcatatttaatttcccgaaataaaaatccgcacattttacgtgcggattacaatttatcatttcctatttttgaactgtagctaaaaattctttacgagtatctctatcttctaagaatacgccaccataagcagatgtgacagtataactattcgtatctctaataccacgcgctttcacacagaaatgggtcgctttcacatataccgccacatcatcggtctcaagaatggtttgaaatgctgtcaaaagttgctcagttaagcgttcttgaacctgtggacgttgcgcaaaaaacgagacaattcgattaattttagaaagaccaatcacccaatcttttggatagtatgccacacaaactttaccatcaatcgtcacaaaatgatgttcacaagtgcttgttagcgtaatgtcattcacttgtaccatttcgctgactttcatttgatttttgatttttgtcatctttggaaaattcgcataatccattccactaaaaatctcatcaataaacattttagctaaacgatttggcgtttcttctaaactatcatctcgcaaatctaatcctatcagcttcattacttcatgcatgtgttttgcaatgctttctcgacgttcatttttagcctgtgttggatcaatcatgggtgtctcaatacctttttcaatcaaggcatttcttacattcagtgcatccagtgaaattttgctcataatagtctttcctaaaaaaataatcggctattctagcaaaggataataggatggtaaaatgagaaaaattgcaaatttgaatgaattaggctttagatatagaatagctgacaaattttatcaaataaggattttctatgcttacattggatcaagctcgctcgaaaatgcttgaacagcttcccttcccgactcaaactgaatacctaaatttacaagaagccgccaatcgaatttgtgcagaagatattatttcgcctatcaatgttccctctttcgataactcagcaatggatggttatgctgtacgtttatcggatttacaacaatctttaaccctttcagtggcagggaaatcttttgcaggtaatccattccaagaggaatggccatcaaaaagtgcggtcagaattatgactggtgcgatgattcctgaaggcacagatgcagtgataatgcaagagcaagtaacactcaatgaagacggcaccatcacttttagtgaattacctaagccgaatcaaaacatccgtcgtattggtgaagatgtaaaaaaaggggatgtcgtattagaacaaggcgcacagctcaccccagtttccttgccattattggcctctctaggcattgcagaagtaaaatgctatcgtcaattaaaagtcggtgtactctcaactggcgatgaacttgtggaagtgggcaaaccattacaaagcggacaaatctatgacactaaccgtttcaccgtaaaattactgctagaaaaactacactgtgaagtcattgatttaggactattacctgataacgaagctgaatttgaaaaagcatttattgccgcacaaagccaagccgatttagtgattactagtggcggtgtttccgttggtgaagcggatttcactaaagcggtattggaaaaagtaggtcaagtaaatttctggaaaattgcaatcaaaccgggcaaaccattcgcttttggtaaattagaaaatgcttggttctgtggtttacccggcaatcctgtttctgcattagtaacattttatcaacttgttcagccattaatcgctaaacttcaaggccaaaaacaatggaaaaaaccaccgcacttttcagccattgctacaatgaatttgaaaaaagcagtgggacgtttagacttccaacggggtttttattacatcaatgaacaaggccaaattgaagtgcaatcagtaggtttccaaggttctcatctctttagtgcttttgtaaaaagcaattgttttatcgttttagaacaagaacgtggcaatgtctctgcgggcgaaacagtgacaattgagcctttcaatcatttattaggataaaaaatgatcgaacttagtcacgaagaagaattgcgttataaccgtcaaattattcttaagagcgtagattttgacgggcaagaaaaacttaaagcaagcaaaatgctgatcgttgggcttggtggcttaggctgtgcagccagccaatatctcgcagcagcaggtgttggaaatttaacgctgttggatttcgatacagtttctctttcgaatcttcaacgccaagtcttgcactgcgatgctcgcttgaatatgccaaaagtggaatccgctaaaattgcactggaacaaatcaatccacatataaacatagagacgattaatgcgaagttagacgaagaaaaactcgcagaaatcattccgcactttgatattgttttagattgtacagacaatgtggaaatccgtaatcaattggatcgccaatgtaatcatatgaaagtccctcttatttctggcgcagcgattcggatggaaggtcaggtttccgttttcacttatgaaccaaatacgcctacttatcgtgatctcagcaaattatttagacaaaatgtattaagctgtgtggaagctggcgtgcttgcaccaatcgtcggtattgtgggctgcattcaagccttagaagcaattaaagtgcggttaaaaatcggtaagaatttgtgtggccgcctattgatgattgacggtttttcgatgaatatccgagaaattaaacttccaaccaatatggaataaaacgcttcaaaagagaaaaaaatttaaccgcacttttatgaaccataacctttacgacaaaacactatgacaacagaaattaaaaaacttgatcccgatacagccattgatattgcttacgatattttcttagaaatggctggagaaaatttagatcctgctgatattcttttattcaacctacaatttgaagaacgcggcggcgtggaatttgttgaaaccgccgatgattgggaagaagaaattggtgtactaattgatccagaagaatacgctgaagtatgggtgggcttagtcaatgagcaagatgaaatggatgatgtctttgctaaattcttaatttctcaccgagaagaagatcgcgaatttcacgttatttggaaaaagtaacgataacgtaaaaataagggaaatcatctgatttccctttttcttttcgcttaaaattaacaagccatcaaattggaaaacttgagaaaaaaactaacaacaacggcggtaataaatttgtcaccataccaaaagaaatggcgataggcgtcacttcaattccacctgatttttgaataatcggcaatgtacaatctaatgccgttgcgcctgtaatctcaatagctgtagagcgataatgttgcataaacaatggaattaaaaataaactcaaaatttcacgcgataaatcattgaaaaaggcaatactgccctgcatcggcccccaagcatttgtcagcacaacacttgataaagaataccaaccaaatcccgatgaaaaggctaaaccttgagtaatcggcatacttagaaaaaatgctgaaataacgcccccaattaaagaacttagggtaaaaattgcccccatcattaaaccctgcttatttagcaagacttctttcaaggaaatgccattgttacgaagctgaatcccaacaaaaaagatcaacgtaataagcacgtaaagattggaaccatttggaaaatgcaaccaatctttgcacagccaacctaaaacgatgccaataattaccgcacttaataattcttccattgttgtccttttttgtagatcactgcactttatttaattttcaaaggtaatttgaataaatattacagtaaaaataaaaaactattatacaagcaataaaatcataccgcttataatatagttttttatcaatctaccaaatgctcaatgttcaaatgccaatcttagatactttgtctctttactctgtaaaaatggaatataaaaagcggcttaaaaataagccgcttgtcatcgttatttttcagcaaacactcgaatttgctctgcacctaaatgtcctggtacggtttttttcaggtttaaatcactatctaaaaagagattaaacggatagccacgcactcttgctttatcaatgatttcgcctttttcatctaaaagcaccgtgatatttttatattctaatcccttgtaccactcaataaaatcagcggtgtctttttcgcctttgtgatcgggcgaaacaatggtaatcacttcaaaattgcgatctttttccgcacttaaatcatcaatttcagctaatcctgccaaacaaattggacaccaagatgcccacatttttacatacacgggtttgcctttatattggcttaaagtaactggctgattgtttaaatctttgagttgcacatccgccaaattagtttgtgcaaaagcgtttaggctgaatgccattagaaatattgatagtagttttttcattgctttttccttttataaatttcttttgttgaggttatgttttacgaaaaattattcgtaatcaataaaatacccatcacgataattaaaattccgccaccaattttaaatttgtctaagtgtttatttaaccctttggcacgttttagcaagctgtctgagaagaatgaaaataatacaaacggcgttgccaagcctaaaacataaacgaacatcattgatgcaccgtaaagtgcagatccttcatcgcctgataaagctaacacggaagccaaaatcgggccaatacaaggtgtccaaccaagactaaaggttaaaccaaggacaaatgcctcaagtgcggttgattttcctgatgtttttatttccaccaattttgtgcgttccaacaaaccaattttgaaaatgccaagttgatgaatacccaaaataatcacaataacgccagcgataatgcgggtggtgttactaaataaaatattccctaaaaaaccaaaactaaagcctaaactgacaaatgtaagggaaagccctaaaataaataaaaaagtatttaggacttttttaccgcctttactcaaaataccaaaataaattggaataatcgggaaaatacaaggcgaaagaaaagaagcaagccccgctaaaaatacagttccaataaggagttgttgatctaacatcctacatctccttattttttaatggattgaatcaaatatccatatcctgccttttccatttctgctaacggaataaatttaattgatgcactgttaatgcaataacgcaaaccacctttatctttcggaccgtcatcaaaaacgtgacccaaatgggcattgcccgcacgacttaacacttcggtacgttgcatattgaagctgttatcggtttcataatgcactacatctttaatgatcggtttcgtaaaacttggccagccacaacctgattcaaatttatcatttgaagagaaaacaggctcgcctgtagtgatatcaacataaataccaggttggaagttatcccaatattcgttactgaaagagcgttcagtatgtttattttgagtaacggaatattgcaacggtgtcaatttcgctttgagttctgcatcactcggtttcggataatctttctcgtcaatcacaggttcatcagctttggtaatatcaatatggcagtagccatttggatttttcttcaaataatcctgatgatattcttctgctacgatgtaatttttaagtggttgcacctcaatttgtactggttttttatatttggtttgaagctgggcgagtgcttgtccgatcaccgctttatctgctccatcttgataataaatccctgtgcgatattgtctgccacggtcgttaccttgtttatttacgctggttggatcaatcactttaaaataatatttaagcaatttatctaacgaaatttggtttgcatcgtaagtaacttttaccgtttctgcgtgatcggttagcccaatcatctgataactggttttctccgtattaccatttgcatagccagaaatcgcatctttcacgccgtgaatacgctccatatatgcttccataccccaaaaacagccgccagcaagataaatttctcgaatgttttgtgtattttccattgccattttttgttctccagatgatgatgttgaattttgtattgctaaagttggtgtagcacagcaaagtgcggtaataaatagaaatgtttttgatagtttcattgtttttccttatgatgtgaaaattaacgttacataaggttagacggcggataatccgatttcttacagatttttttacttaagtttgaaatgtggtagaaaataagaggggaattttaaataaaaaagactaagtctaaattaaatatagacttagtcttgtttaaataaaatgatgttgttagagcagaattttaatgacttactgccatatttagtttagaaatagccttcttaccttcttcttcagaaacttgttctaaatttgcaccgcctacaaatacaccaaatttagtatattgacgaataaaatagtttttaccactttcagttttaatgtttaaatcactattgctgaattcggattcagttgaaattttatgctctcccgctttaatggttttataaaaaaatacatcaggagcagactcacctataaatttatcgtcaatatagagatctttctttaaagcttttcctataaaagaatcacggtagatatataatcctgaatttcctttttcgggagatctgaattgtttggcggtattactttcttcaacagaagccataggaacggttgcacaagctgaaagtaataacgctacccctataattgatgctcttgcaaataactgtttcacaaaatatccattagaaactaaaacgtaaaccagccttaacgcccacatcagaaacatttgaggctaaacggttatattcaatattagtattaagtgccacgttatcagttaatttatattgaacaccagctaatgcaccaatgcctattctcgtttcggttgcaaaagcttctatgcgataatatcttgcatttgcagttacatctgctccattggtagatacacggacaccaacataaggtttgaaatcggctaagtcaaaatcataaaaaccagtgaggcctaatgatttacctttaagagatacatctacaacatcagcataatttgcagttacttttccgtagtttgtataatctacggctaaacgaaagttcttatcaaaagcatagccaacactaattcgttgggtaaaagatggactgtttgaactatttacatgagtaatatcaatttttgaagcacctaaatcgccttgaacataccattgagcttgagctgatagtgctaaagtaaataacatagttacaataagtaattttttcatagattaagacctctaaatgtgtgaaaatacatcagttgcataagtaaatgcgggtaaattttatggaagtttaaccattaaaaacaacaacaaaaaggacaaaatagcacctaatttcggcaaaaattgctcaatttcgaaaggattaaatttagatgggaatgcacgataaaattcgtatgatgagagagcttcgtcaattatcgcaagaagatatggctgagaaaatgaatatgtcgccaagtggttatgccaagattgaacgaggtgaactcgcctacaatacgataaattagtgcaaattgctcagatatttaatatgaatttgtctgaactagtggatgagaatagaggaattatatttttattaaatgaaaatggaaataatacatcaactaactattatggaaataacgactctttaataattgaaattgaaaaattaaaattaacactttttcataaaaatgaattattagagcagaaagaaaaagaattagaaacgcttagaaaaatgatttcattattagaaaagtgaaataaagtatttttaacaataaacggttgaagttgtaaaatattttgcaaattcaaccgcttattttttgctacctatcagttaattctatagatggttcggcatccctaaattgcttcatcatctcgcttaaggttttgcaatttctttgaaaacgacgacaatgtgggcaggtaactaaatgaactcttaacccaactttttcttgtatatctaatgaacgttcgtgcgattcggaaatcattcgagtggcttggtgacaacgcataattttctcctaaagtttttttgaaagacagttttgcaactgtaaacgagcccgataaagggtggtatgtaaattagacgaagttaaatgtgtttcttgacaaatttcttcagatgaaagctctaaaaactctcgcatcataaaaatttttgcctgtttagcaggtaaacaattcaaacaagtttcaaaaatcagccaaaattcatcggaataaaccgtttcttcttcgccttgtaattcactcgggtgatattctggtttccaatgccccttttcatcaaaaaatgaattattagtattttcatcttcaagttcactttctaaaacaaaccgccctttctgacgtaaataatcaataatcttatttttaagaatcgcaaaaatccaagtcttaaatgcagattgacgcttaaaattagcgagatttttgaatgcacttaaaaaagcttcttgtactaaatcttcagcaagatcggcttgatttacttgcaattgtgcaaatgtcagcatttgagtgcgaatttgctgaagctcaagatcagaaataacattcattttaattcctttaaaacttatgtaagaaatgaaactcacttcttttaacaaactaaggtagctatttttacactcaaaaaaggaaatttaaaatgaaaaattttatattgaatctattttgcgaagttaggaaaaaatcaggtgtttaagaaaagaataattgataccgctttttaacgtgatatttgcttggtgtgtagccgacaccaattgccatcgcattacaaaccgcccaccgcagcagaaaaactcgcttttccaacgacttgaggtaacactaaaccagaaagggcgttagccgccactaaaccacgttctaatttgctgtccaatttccctaatttgccatttaactcgttaaagcctgattggaaattattcatttgagtttgtaacgtgcctaatttgagatcggtatattgatttgcagtttgtaaagtttgtgtatcgccatcttccatttgttttttatttactgcatcagtgtctttttcggctgtttttacattagcaacatatctttctttaccttctctaccaaaagaaacttcattttctcttgtagtttctgaactatatcctacagcaatagagttgttatatttagcttttgctttgttacctagagcaatagcattttctacttcattagtaccagtttcatttttagcttcactttcataacctatagcaatgttatatgaaccttcaaccttatttgcccccccaatactgtattatatataccatctttgtaagtcctaaagtcttcggcttttttactattaattgtattattctttaaattaccaatgatcaggctatacgccccaaactctttaatgccgtaattcgtactaattgaattttcactcgccgcaaaggcttgagaagagatcagcaaactgctgataagttaagctgtcgtggttagcttgacagatgaaaagaaaagattagcattgcttgcttgcttgcttgcttgcttgcttgcttgcttgcttgcttgcttgcttgcttgcttgcttgcttgcttgcttgcttgcttgcttgcttgcttgcagaattgtaataaaacatattatatcctcctaggataaaacaaaaaagaagcgtgactttacgttaaataaattgatgtaaaggaaatacaaattttttcgtgcaaattccaatatttaactttaaaatacttgcctctgaacaaacattcattataaataaaagtcacaatatttattttataaataaaaaagtgcggttaaaatcatccgcactttttagttcgtagaaaggaaaattcaatgtttaaaatgaaaaatatcacgcttgctttgttgatgtctggtgcattggtgggatgtgccaatattggcgattcttatcaagcaagccttgaagattacaagcaatatgaagaaattaccaagcaatataatgtaaaagaaaattggtggtcgttatatgatgatgcgcaattaaatcgcgtagtaggacaagcattaataaacaacaaagatttagctaaagctgctgtagcggtaaaccgtgcactttatagtgcaaatttagtgggtgcaaatttagtgcctgcatttaatggttcaacttcatcagcagcacaacgccgagttgatatcagtacaaactctgccatttcacacaaaggttctttaaatgtgagctatacattagatctgtggcaacgtttggccaataccgttgatgcggcggaatggtcgcacaaagcaactgcagaagatatggaatcggctcgtttatcattaatcaattctgtagtaacaacttattatcaaattgcttatttaaatgatgcaattagcacaaccaacgaaacgatcaaatattacacggatattggcaatattatgcaaacgcgtttagtgcaaggcgtggctgatgcagccagcgttgatcaagcacaacaagccatattaacggcacgtaataacaaattaaattttgaaacccaacgcaaaacagcagaacaaacactgcgtaatcttctcaacctaaaaccaaatgaagcattaaatatcacgttcccacatattatgaatgtgaaaacagcaggcgtaaacttaaacgtgcctgtgtctgtaattgcaaatcgtcctgatgtaaaagcagcacaattccgtttaagcagtgcattcaaaaatgccaaagcaactcaaaaaagttggttcccagaggttaatttaggtgcaagcctttcttcaacagcaagcacggttggtacggcgttacataaccctgtggctgctggcacagtaggaattagcctaccgttcttaaattggaacaccgtaaaatggaacgttaaaatttctgaagctgactatgaaacagctcgtttaaattacgaacaacgtattaccaccgctctcaataatgtggataccaactatttcgcatttacccaagcgcaaagtacattaagtaatttacagcaaacccatagttacaatcagcgtatcacacaatattatcgaaaccgctataatgcgggcgtatccgaattgcgcgaatggttagttgcagccaatacggaaaaatcatcacaacttgcgattttgaatgcaaaatatcaagtgctgcaaagtgaaaatgcggtatatagctcaatggcgggatattatttgtaaaaatcaaattggattaatctatgaaaaatccctgttaaatttctttaacagggattttgttatttaaattaaacctattattttgtcgcttctttcactgcatctactgcttgagttgctttttctgaaaccgcctctttcatttcacttgctttttctgatgctgcttctttcatttcgcctactttttctgacgctgcttctgttgctgatttaattacttctttcgcatcttccactttctctgctactttatttttcacgtctgtagaaagctgctgtgctttttcctttacttcagtcattgtattagctgcagcatcttttgtttctgatgcgactgatgctacagtttgcttcgtatcctcaactttttgttttgcttcttgcttatcaaaacaacctgtcacgactaaagctgaacctaaaaccaatgctaatgttaattttttcattattttctccatagaataatttgattgtnacaaagccctattactttgatgcagtttagtttacgggaattttcataaaaagaaaaacagtaatagtaaaactttacctttctttaaaaagattactttataaaaaaacatctaagatattgatttttaatagattataaaaaaccaataaaaattttattttttgtaaaaaaaaagaatagtttattttaaataaattacaggagatgcttgatgcatcaatatttctgatttattaccatcccataataattgagcaatagttgcaggataaaatgatattggatttcgttttccatacagttcagcaacaatttctcccactaagggcaaatgggaaacaattaatacagatttaacgccctcgtcttttagcacttctaaataatcaatgactgaatgcgcatggccataaggcgtaatcccctcccaaatttcaaatttattttctaactccaaatcaaacgcttgattaacttgatgaaaggtttcttgagctctgacataagggctcactaaaatacggtctagtgaattaattactagcgtgcttaaatgctgttttaaccactgcccttgtaaaaaagcctgtttagaaccataaacagttaaatggcgagctttatcactattagccattacttccgcttcgccgtgacgcataataaaaatgttcattttgctttcctaaaaactttataaaaataaaccgcactttactaagtgcggtcaaaaattaattaatttttttcacggcttctgcaatttcttctgcacattgttgtgcaagttcagcatcttggcattccaccataacgcgaataagtggttccgtacccgatttacgcaataaaatacgacctttaccttctaaacgtttttcaacctctgcggcaacagattttacagcatcactttcaagtggattttccccacccgcaaaacgtacattgattaacacttgagggaataatttaaccgcacttgctaattcatttaatgataatttatgctgtgccatcgccgccaatacagccaatgacgcaacaatgccatcacccgttgtattcttatccgcaatgataatatgtccagaattctcccccccaagcgtccaatcattttcaaccattttttccaatacataacggtctcccacgtttgcacgtaagaagggaacaccaagcattttcaacgcaatctctaagctcatattactcattaaggtgccaacgacaccgccttttaattgacctgagcgcaatgcttcacgcgcaataataaagagaatttggtcgccatcgactttatttcctaaatgatccaccatcataatgcggtcaccatcgccatcataagccaaaccaacatcagctttcgtttcaacaactttagcttgcaatgcagtcacatcagttgcgccacatttttcattaatgtttaaaccatttggatccgtaccaatttcaataacttccgcaccaagttctcttagtacattaggggcaatatggtaagttgcaccatttgcacaatctaccacgatcttataaccttccaagcctaaatgagcggggaatgtacctttacaaaactcaatgtagcgtcctgctgcatcattaatacggctggctttacctaattcagcagattccacacaatccatcggttgctctaacattgcttcaatagcttcttcaatttcatcaggtaatttagtgccttttgctgaaaagaatttaatcccattatcataataaggattatgagaggctgagatcacgatacctgcttcagctcggaaagttctggttaaataagcaattgcaggtgtcggcatagggccggtaaatgcagcagataaccccgcagcagccaaacctgcttcaagggctgattccaacatgtatccagaaattcgggtgtctttaccaattaaaaccattttcgaaccttgagaagccaacacttttcccgcagcccaacctaattttaatgcgaaatctggtgtaattgggtaagcacctacttttccacgtacaccatctgttccaaaatatttacgatttgccataataaaattcctttaattttttatcgttataaaaccatcaggcatttgctgttgcctgccaaactttgagcatatctgatgttgcagcaacatcatgtacgcgtaaaatttttgcacctttttgcactgcaataagcgcacctgccgcactgccaattattctttgatcaacaggtttatcaagcactgcgccaatcattgatttgcgagataaccctgctaatacgggataacctatctgacaaaattcattcagattttgtaataattgataattatgctgtacagatttgccaaagccaaagcccatatcccaaattaaattttcttttttaatgccagcagaaaggcattcattagtacgtttttgtaaaaaagccaatacatcttgcacgacattttcataataaggatttgcttgcatcgtgcgaggttgcccttgcatatgcataatacaaacaggtaaagccagttttaccgccgtttctaacgcattcggctcttgcaaagcacgaatatcattaatcaaatccattccaacatttgccgcttcacgcatcacaacagcttttgaggaatcaacagaaatccagcaatcaaaacggtttcgcaccgcctccactactggcacaacacgatgcaattcctcttgttcagaaacttcatccgcattcggacgagtggattctccaccaatatcaataattgtcgccccctcttctagcattttttcaacttgaaaaagtgctttatctagactaaaaaactgtccgctatcagaaaaagaatcaggcgtaaaattaagaatccccataatttgaggcacgcttaaatcaagacatttattatttgcgtaaagtttcataaaatgcggttaatttttagagtgattttggtgggcgattatagcgaaatacatccaagaacaaaatcattaggaaaaaataaagcctttccgaagaaaggctttgatgagttaaacattaaaatcatcggtattttctaccgcactttcgggctttgtatcattcgttgttgaatttgcataagcagcctgctgagttttcggctctccccaacctgatggcggtgtgacaggttcgcgattcatcaattgtttaatttgttcttcttcaatagtttcatatttgactaatgcatctttcatcgcatgaagaatatccatattgtcgatcaaaatctctcttgctctcgcatagttacgatttacaattgcacgcacttcttcatcaatcgaatgcgcagtttcatctgacatatgtttcgctttcgccattgaacgacctaagaaaacctcgccctcatcttccgtataaagaatcggacctaacttttcagagaatccccattgcgttaccatattacgcgcaatattagttgcgactttaatatcatttgatgcacctgttgagatattttcttcgccgtaaatcaaatcttccgctaaacgacccgcatacaaggtagaaagcttactttctaattgtttttggctaatactaatttgatcgccctcaggtaagaagaatgtcacacccaaggcacgtcctcgaggaataatggtcactttgtgaacaggatcgtgttcaggcactaaataccccacaatcgcatgaccagcttcatgataagcagtggattctttttgcttatccgtcataatcatagtgcgacgctctggccccatattgattttatctttcgctttttcaaactcaagcatggttaccgtacgtttattcactcgagcagcaaacaaagccgcctcattgactaaatttgctaaatctgcaccagaatagcccggcgtaccacgcgctaacgtcattgcatcaacatcttgcgcaacagacactttacgcatatgcacttttaagatttgctcacgacctttcacatcaggtaagccaacaactacttgccggtcaaaacggcctggacgggttaaagctggatcaagcacatctggacggttagttgctgcaataacaattacaccgtcattaccgctaaagccatccatttcaactagcatttggtttaaggtttgttcacgctcatcgtgtccgccacctaagcccgcaccacgttggcgacccactgcatcgatttcatcataataccattgattaatgtaatagacattaaatgataatgattttcatttcttaatttgttgtattttttttatacttgtaacctttttttaacctagatttaacttttgggaagcaatttatgaattttaaattaagcttagtttacaccgcactttttgctgggatttctgtttctgcgttagcagaaacgcgacataaagctaatactgaaacgattgaacaaattaatgttcaagatacaggtattaaacaaaatggttatcaaacaacagggacatctgtcgtatcaaaagctgaagtgccagtattcgacacgccaaacacagtaaatattctttcaactaaactactagaagatcgcaaacctgaatcactcattgatgcgctttataacgtcagtggtgtgagtcaagcgaatacgttaggtggtatgtttgatgctatccaaaaacgtggttttggtagaaaccgtgacaactcaattatgcgtaacggtttacaagctggcccagctaaaaactttagcgcgacaactgaaaccgttgaagttttaaaaggacctgcatctgtactttatggtattcaagatccaggtggtgtagagttaatatcattactaaaaaaccacaacaaacgccacgttatgtcgttggtggaaccttaggtaatcatagcctgtggggaacgcaattagattttactgatggtttaggaaatggttttgcttaccgctttatctatgataaacaagaaaaagattactggcgtaattttggaaaaatcaaaagtacaacttatgcaccatctctttcttgggaaaatgataaaactaaagtagctctttcttatgaacacaaagatattcttgagccatttgatcgtggtacaaatcttttaacggcaactaatgcattacctaatattcctgtttctcgtcgtttagatgaaccaaataacgaaacaactgcaaaaacagataatattgattttaaagttgagcacaaattaagtgactgttggaaattaaattttggctatagctacgcacgttataaacatttctataatcaagcccgaattaaagatattaatgtatcaaacattaatcaaccaaaaaaaccaataaaacacttggattaactgctcgtagcgcaactcgagatattgagcaacaaactggagagcaacgtatccatagtgtttctttaaacacagtcggggaatttgctattggagatattgcgaatcgctttgttgtgggcacagatcttatgagaaataaaatggatttaggaccaatttataatactagagacataaatgatggtaaggttattaatattgacaacccaaattataccaatccagtggcaataaagnaaaatgaaaataacaatgcctaccaatttaatcacttaaaaactttaggtctttatattcaaaataccacttattttacagataactttattataacgggaggacttcgttatgaatattttgatcaagttgttggtcgatcaacattaaagaatattagaagtggatatctggctcaaaaagacgggaaacttctctatcagttaggtagtgtttataaatttactccaaatattgcaacattttttaaccatgcagaatcattccgtccacaaaataatagaacgcttattattaatggcgaacttcctgctgaacagggtaaatcttttgaaacaggtctaaaatatgagaatgcatatttaaatgcaactgtagctttatttaatataaacaaacgtaatgttgcagaaacagttaatgttaatggcacaaatgaactacaaattgttggaaaacagcgttctcgtggcattgagtttgatctaaatggacaacttactgataatttaagtattgcagcaaactatacttacacaaaagtaaaaaacctagaaaatcacaacaataaattagctgttggtaaacaactttctggcgtaccaaaacatcaagcatcattattcttagcctataatatcggcgaatttgattttggtaatattcgtgtcggtggaggtgcgcgttatttaggttcttggtatgcctataataatacttatacaaaagcgtataaacttccacaggctattgtttatgatacatttattgcctatgacacaaaaatttcagggaaaaaagtatcctttcagttaaatggtaaaaacttatctaataaagtttactccccatcaacttcagggaatgcaagcagaacgcttattcctgttgcgttaggttatgctcgtgaagttatattaaacactaaaattgaattttaattagtcattaaaacctagggcaaactggcttcgctctttttctatttatggaaaactaatgaactggcaaaccgaacttaataatagtttaaactggattttaaccgcacttttttgggtggtattgtgctttagcgtaacaatgttagccttaaaacaaactactttcggcaaaaaattctggtgtattgtctctccatcaatggataaaaaaacaagcattaaactaattttaatgttgttagtactatttataatgatattgttggaagtacgatttagtgtacttaattcatttttttacaatggattgtatagctcaatgcaagaattaaatattgagaaattttggttctttgcaaaactaaatgctctccttgtggtagcacaagttatacatgccattgctgattacttctttcaacaagtatttgaaattcgttggttggaaagctttaatgcaacacttgttaaacgctggctaaataagaaaaaatactatcgcctaaaatatgaacgagatttaccggataatatcgatcaacgtatcgaacaagatgcgagagaatttattaccagtacagtacaaattgtgcgaggcgtgattaactcggtgctcacgaccattgaatttacgattattttatggtcactttccggcgtattaactttattcggatttaatatcgaaaaaggcgttgttttcttcatttatgcctttattatttttgcaacactcatgtctgtttggattggtcgccctctaattaagctaaattttacaaaagagaaactcaatggcgattatcgttattccttaatccgtgtacgagacaatgcagaaagcattgctttttataatggcgagccaaaagaacaaactttcttacaacatcaattccgtcaaattattcataaccgttggtccattgtattaaaaatgttgggcttaaatagtttcaactctggagtaactcgcgtggccaaattattgcctttaatgttacaagcaccacgttttttttctggtcagataaaactaggagatatgcatcaaacagtccaagcatttaaccgattaatgaccgcactttcattcttccgcttgttctatgagcaattcacactctatcaagctcggttaaatcgtctttatggttttataacaaaaatggatgaattagataaacaaaacgttcatcatccttttcattgctctcatcgtgtcgccttaaaaaatttcggtattaaagatgaacaaggtcatgtactactcaataatttaaatattaatttagaaaatggagatgccctattgattcaaggtgcatctggaacaggaaaaacatcgctactaaaagcaattgcaggaatctatccttttgaaaccataggtattgcagagcatccatgcatgggaagtttattcctgccacaacgaccttatatgccgcagggtactttacgagaagcaatttgttatccaaatatcaatccaagtcacgcagaattggaacaaaccatgaaggattgtgcgctaggaaaatatatacacgcacttaatgtaaaaaatgactggcaagcgattttatcgcccggtgaacttcaaagagtggcgtttattcgtattttactcacaaaaccagatgtcgtatttctcgatgaaacgacttcagcattggatgaaacaaccgagaatttactctaccaaacaattaaagagcgtttgcccgaaatgatcattctcagcgtaggtcatcgtagcacattacagcaatttcataacaaacaactaaaattagatgtatgtttattatgtgaaaattagaaaatagcaagttaatatatcagccaaatattttatttattttgatgctagtctgaagagcgcctataaaattaaaataaaactataaaaaaagcctcgatattcgagggcttgattttttactatcgtaataaaaattagcgacgtaaacctaaacgagcgatagtgctttggtataaagcaagatcagtacgttttaagtagtctaaaagtttacgacgacgagaaaccatacgtaataaaccacgacgaccatggtggtcttttttgtgctctgcgaagtgagtttgtaagtggttgatttgtgcagttaataatgcgatttgaacttcagaagaaccagtatctttcgcatcacgaccaaattcagcaacgattgctgcttttttttcagtacttagagacattttttactcctaaaaaagagcgatcaaatagcaattcaaaaatggatttatgacggaagtgttctaaatttaacgtagttaatgctaattgattaaaggctatcgttaatttttgataaatttttttagaatcagctaattgaagcacatttccaggatttgcactaataaaaatatcacctctattcccttgctcaatttgttgacgcaagattccggctggaccacaaaatgctttaatctctatatgatgaatttgtcgaaaaatatcagataattcttgcagagcataacaaaaactacctgcgctaaaaacagtaattgattccacaagttttccttactttaataacgttttatacaagggaacaaaatgcgtaaaaaaagattctttatattgagcttgttgttcaaacatcggtaaatgaaaaagtgcggtcaaattttctgaggttaaaatattccttgtttcgccaaatttaaaattttgtttatttaacaataaagttttattggctatcgctacaacttgattaggttgatgtgttgtgaatacgacagtcatgttctgtgattgtgccaaatcgataagtaaagacagtacaatatcttgatttgcaagatctaatgctgaagttggctcatccaacagtatcaatttgcattctgaagcaatggctctcgcaattaaaattagttgtcgctgcccgcccgaaagcgaagtaaattcgcgctttgccaaatgggtcaagttcaaataatccagtgcctgcatggcgacttgataatcatgcgatttcggtttggcaaaagtattaatatgggttgagcgccccatcaacacgatatccaatacggaataagcaaaaggcgaagaaaagaattgcggcacaaaaccgatagattgatacacctcaatcttgccctgaatcgggcgatgaatgccaagcaacaaatccaacaaggtacttttcccgcaaccgttttgccctaaaaccgccagaatatctcctttattcaaatcaaaattcagttgctgaaacaggaagttttccgcttggtaataaaaacctagattttccacggagagcgctttattcattcatgcctccgcgttttagtttatataccaatacaccaaacaacggtgcaccaataagtgcggtcaaaatactgattggaatttcggcatcggatagggaacgcgcaacattgtccacaagcaacatataagtcgccccaacaagcatggtgcaaggcaataaactttgatgattggcacctaccagcatacggctaagatgaggaatgatcagcccgacccagccgatactgccgctaattgccacctggcatgccactaacgaaccgcttaaaaagatcactaaccaacgtaatggggccattttcacgcccaaagccttggcttctttctcatctaaagacagtaaattcaagcgccaacttaagctgagcaaaatcgagctacacagcaaaaacgggacaaagaaaaagaggagtttttcccagttagaggtggcaaaactccccatcaaccaaaacacaatgcttggcaatttttcttctgtatcggaaatgtattgcaataggctcactagggctgaaaaaagtccgcttaaaatcatgccgataagaataagcatcaacaagctgcgttgattaaatttgaagctaaatagaaaaaccaaggcaagcgtgccgaagccgaataaaatagtgctggtaaataagccgtataaactgaatccaaagaaaattgccaaggtgccaccgaaggctgaaccggaggtcacgccgataatatgcggattcactaacgggttacgaaaaatgccttgcaataccacaccactcaatgccaaaccggcacccacgcaaagtgcggttaaaattcgaggtaaacgcacttgaaaaatcacctgttgctgcactggatcgatctcaagtgcggtcgcttttgcccacagaatttgaccaatttgcggtacagacaaagaataccgccctattcccaaagaaatcacggcggtaatcacaagcaacagcgttaagccaaagagaattttagggtaactatctggctgcattgtcgggtttgtaagaagtgcggtagaatttttggtaataatcgttcaccattttatccaaatccacgtcttggaaacgttgcggataaagggctttagccaaccatacttcgcccaatgctaaggcttccggcatcgggtatccccaggctttagcatattccggcatcaaaaaaacttttttatctttcagtgcctgaatattcgcccaaccttgatcgttcaaaatttgtggtactacatcaggataacgatcttgcaccaaaatcaccgcaggattccattccaacacattttctagagaaacctgtttgaaacctttaatggttgccgctgcgacgttataagcgcccgcatgttccatcataagccccgtatatttaccggaaccataagtgcctaaatccggatttgccatataagtgcgcacacgtttatcggcagaaacgtcgcctaggcgatctgccaacaacttacgattagcaaaggcagctttcactaactcatcaccttgttgttttttctcaaacacctcggcaatcagttcaatgccctgttttaagccgtcattataagctttatcttcgtcagttaaggttggattaagtttacctttttcgcccacttcaccagtacgcaaggaaatggctaccacagggatattcacgtcactgatttgcttgatcatttcagacggtgcgtagttagtcacaaacaccacatccggttttaacgccaacaaactttcaatattaacggaattcaaatcgcccggcatcgccatgttttccagttccggtgcaaggcgaacatagtttttgcctagttgtttcttccagttggaaagcactcccacaatctgttttgtggcatccaactgcacggcaatattcaaagtttggtgctgtaacaccacggctcggttaatgtgatcgggaattgtcactttgcgatcgagttggtccgtaataatgcgatcagctaatgctgaaaaagaaagggaactgagcaagcaggcaattaacaatgatttaagtttcatcgcacatccttattttaagtaagaaaatatcattatacacatatttatataatgataaactatgtactcatatcttttcaatcaccacctttatatcttctggcggtacataataaggtgcagaagtgataaataaacgaatacccaatttggcgtaatctgatacattatttttatttactcctccagcgacagaaagcagaatatctttctgttttgattgaagtagatctaaagcctttttcacatcctccaataaccatttatcaagttgaataatgtcgggttcagccatatacatttgctcaaattgagcataattatctgcttctaaagtaattttattttcaggtgcttcttgacgtaatctatccacaattttcgtccaatcatttggatcagaaagtaagtttcgatgattagtaaaaaccaaaagagtttcgctaacgccttgtcgatgaatatgcccaccagcggctaatacagcattcgtcgcaagtttacgcgtattaggaatacttttacgcgtgcaagccacaacagcagttggattaaccgatttggcattggcaatcatttctgcagtatattgagcaaccccacatgaccattcaagcaccaattgcaccactttccaagcttgatgtaattgttcagacattccttccgcactgatcaacaaagcacctgattcaacccactccccttcttttacatataagtgcggttgaatatccagtttttttaataatttttccgcaacagaaacacccgccacaacccctgcatttttacgcttaaacagaatttttgccggaatattttcaatactaagggcatgagtggttaaatcaccacgataaatgtcctcaagcaataaatcatccaattctttatctgaaaaataaatcatcgtaactccttaaattaattgaccctgatataactgaatctgcttacctgaaaaatactcggcttcttttggctcatgcgttactaaaattgttgtaatttcatttgtttgaattaaattttttaacactttccaaatatctttacgggaagaccaatctaaagaagaaaaaggctcatctaaaagtaataaatcaggacgataaattagtgcccttgctaaagctacacgctgttgttctccaccggacaactgatgaggatagcgattaataagatgatctatttttaattcagataataatatctgttgttcagcatcagatgctgatggattagcaagtattaaatttcctcgtaccgttttatgaggaaacaaataaagtcgttgatttaaataacgaaaatttctcttccacggaggattattttctagaacttggttattccataaaatagagccagaataatcaatataaccagcaatcgcatttaataaagtcgtttttccgctacctgattcaccaacaacagaaaggcattcacttttttcaattgaaaaagaaatagattttaaaatattagtttgaagattctgaactattaacatactaaacagccctattaatcatccgtaaaactagcaacaaacatgaagatataaataaaagccataatgatgcgccaatagcgatttcaaaatcaccacttgaaatattcaaatagactgccataggtaaagtttcggttttaaatcgcgttgcccctgccaacattaatgtggctccgaactcccctattgcgcgagaccaagctaaaactgaagcacaaaccaaaggcttccaacacataggaatctctatttttattaaagtcttaaacggtgataactcaagagtataagatgcaaatcgataacctgattcaaaggaagaaaaaataccgcgagtgctacgcatgttaaaaaccaccaaaacaaagaaaacaaaagaaataggaatttggcgaaattttacggacgtaagtgggcgggaattattgaaaacaggggctttggcggtgcattgcccctttttttattcttagggaaagaaaactaagaaaaaatcagatctttggttgatttagtcaaaatgaaccagaaaaactaagaatttaaacaaaaaagaaaacgcccgtttaaatggcgtttaaatctttaaatcaggctatgcccgatatgcactacttgcccgatgatttgtaggttttgagcattttcgcctgtaatgctgattggcgggtattcctctttgttatcgctgataagcgaaatgccgtcccattccatcttcacacgcttaacccacacactttcgccgttttgaacaaggtaaatgcggtcgccttgaatttctttgcggcttaaatctactaacatctgatcgtagttattgatagttggcagcattgaattgccgtttgcccagaatacggcgcagttatctgcttttacgcctaggcttgttagcaattcgtctgaatacggctcttgtccatcaggctgggtgataccctcgttaaaactcccaaatcctgcagaaacgttgatggagctataactatcaatcatactcaccccttcctctaacatggcttgcattctttcaaatgcacggctaacaaggcttcctgcaggcttttcttctgttgtcttttcttcttttattttaccggtcgcaagccattcaatgcttactcctgtaacttctgcaatttttacaaggttggaacgagatggatcggcttcaccttttcgccatcttgtaattgtagaaagtgttacgcctgtttttcgagcaaattcgcttgggccattcagtttatctactagatattcaatcctttctgggaaattgtcttgattttggtactgcatactaacctctttagtcgtaatagttgaataattacaactattacgggattaaaaactaaattattacccgtaatagaactaattaagtcattgtttttattcgaaatagtaaaacaatagattaaaatatagccaaatgaaactattacggtgtattttatagttgcaacatgcaactattacggataatatacaccacataaggtacagcaaaaaaggtgtattaaatgagtgtattagaaaaaccaaaaaaaaccgcagaacaggattggcaccgcgccgatattcttgcggaattaaaaaagaatggttgngcttcgctctttagcaaaagaggggcaagtcagctacaacacattaaaaacagttttggataaatcttatccaaagatggagcgtttagttgcaaatgcaattggtgttccacctgaagttatctgggctggtcgttttgctgaacgaaataaaagaccaacattacaacataagtactgattttaaccgtaaaagttataaaaaggaacatttatggataatcaaagcttaaaaacgcactattcagtgtatgaattagcaaacttaaagctaaaaacactaccttcagcccccaaaaacatttgggaacaagccaagcgagaaaactggaaatctcaaaaacgccaagggcgtggtggcgggctggaatatgaattagccagtttgccaatcgaagtgcaaaacgagcttctgctcaaaactaccccagagcaaacggcggtagctttgcaaaaaatagaagaaactcgaccgcttgcaagcaatgaagtctggcaattatgggacgaagcaagtgcaaaagcccaagagcaagcaaaaatcaaacttggcacgatgtttgcagtagcaaatttagtggaaagcggtgtgaacgtgttagatgccttccggcttgtctgtggcaaagaaaatgccgaacggctgaaaaataacgaaaaattactctcagttggttctttaaaaaattggtggtatcgggtcaaagacgccccacggcaagattggctgcccttgatgctcaacaacagcggcaagagtagcaaaaacgtggcagaaatagatgaagctgcttggcagttcttcaaaaatttctactacagtcgtgaaaaaccctcactggctcacagctatgaggtattaaaacaagccgcacaatacaacggttggcgcattccctctcgctcttcgctaaaacgcaaaatggaacgagatgtaccaaaaaccgaagaagtgttccgtcgtgaaggccaatacgcattaagtcggctttatccctcacaggttcgcaccgtggcaatgttacaagcgatggagtggatcaacggcgacggttatcaacacaacgtttgggtgcgattccctgatggcgaaattaaacgcccgaaaacatggctttggcaagatgttcgcacccgaaaagtgctggccgctagaaccgataaatcggaaaacaccgacaccatacgcctcagtctgcttgatgtgattagtcgctacggtttgccgaaacacttaaccatcgacaacacccgagcggcagccaacaagaaaatgacgggcggggtaaaaaaccgctaccgctatcaagtaaacgaaaacgaagtgcaaggcattattccggcactcggtatcgaactgcactggacgtcgattcaattcggcaaggggcgcgggcaagccaaaccaattgagcgtgccttctctcacggcggtttgggagattatgtcgataagcacctgttattacgcggggcttatgcaggggcgaatgcctacgaaaagcccgactatgacggcaaaaacggcgcagaacagcctgtcgattacgccacattcttaatggcattagagcaaggcattcagcaatggaacaacgtgggcaaccgcctcaccgaaatttgtgcaggcaaaagcagttatgccgaagcctttgagcgagattgggctgttgccgaaaaacgcccgattagccaaagccaaatgcggttgttgcttaccctgcatgaggaagttcgccttaaccaagacggtaccttctacctaaacgcaggcaaaatcggtacgaacaaaaaccgctatgagtnactggcgcttatcggtacctcacacaaacgcgttgtggtgcgctacgacccagccaatctgcacgacaaagtgtgggtttatgccttnacgggcgaatacttggcggaagcggaaatcaccgaaaaagcaggctttggcgaccaaatggcaggacgcgaacacaacaaagcaatgcgcaactgggtaaaacataccgaaaaagcggcgaaagaacgcgctaaagcggaagaaatggaactcagcaattacgccccggcggtcgaatttgaagagcggttcttggaaatgttgccagagccggtaaaagcccctcaaacgcaagcagaagaggtggaatatgaagaagtgctagatttcaacaccgtgcgaaaagtaccgaaagcagtggaagtagaagccgaagaaatcagcgaatttaatcgtgattgggaaaagggtttagagcttttaaagaaaagtaaagggcgttaaaccaaccgcctttaaaccagatttaaacagggtttaaacgccctaaggagaacaagatgagcaatatcacattaaacgaaaacgcaatgctttatttaaaagcagactattatcgccctgaaatgcccacttttaaagcctgctatttccgattaagcaaaattgcccaagaacaaggctggggaacattgccgaatttagcccaaaccaaagccctgtttaaagcggcagtccctgagattatttggacgagagaggcgtttaagcgtgccaatactcaaaagaaacacgcacataaggcaacgccttatcttgaacaagtaatgtaattcgagcagcaaaactctcaggtaacagcacataaaacggagctggcaagttagataaatcaagtggttcagagcctattttgttcaactctaacacttgaagatggcgagatttcaattttgcgattagttgatgaagaaatgctgaacgtgaattacccaccacagcttgtaacgcatcatcaagattaagccaagaggcagaaccgtgagcaggcaaggcttgagcaaattttaaaaactgcttatgccaattttcttcagaaagcaatgaggttggctctttttgtacagaatgttcaagtttagtaatcacttctgaaaattcgtgaaaaagtgttgccacggagtagagcttaacaggttggcgaaccatttttaacagtaaatcagtttcagacataacgcccccaaaggtaaaaacaggaaacccattatgacactaatcaacaaactcaaacaacacttaagcgacagccaaatcacccaagcccagcttgcccgcgaagcaggcgtaaatgcaggtgcattgtcggcataccttaacgataactacaaaggcaatattgcagatgtggaagcaaaactggcagcttaccttgagaaaaaagcggtgcaagcccgcgagtttgtagaggcaccagcctttatcgaaacagcgacttctcgtcaaattttcaaaacgctggaatttgcccaaatcgccaactgcttagcgactgtttacggcatgagtggcgtaggtaaaaccaaagcgatccaagagttcgccaaaagtcacgctaacgtgtggctggtaactgcaagccctagtcgttcaagtttaagcgaaattttgtatgaaatcgcccttgagttaggcatcagcgacgcaccacgcagaaaaggcacactctcacgcctgattgctcgcaaaatcaaaggcacagagggcttgctgattgtggatgaagccgaccaccttccttatgaggcactcgaagaactccgtattatgcaagaagaagccggtattggcttagtgttggtaggcaacgacaaagtctatacccgaatgaaaggcggtattagcccaagccacgaatatgcaagattgtggtcgcgcgtggcaaaaaacaccagcattcagaaaactaaaaaagcagacacgcaagcagtcgctcaagcgtgggggttagaaaccgacgaagaagccttaaaagtgatgcaaagcattaccgaaacaggcggtggtttgcgaattttaacccaaacctacgcttgcaggaatggtagcaaaaggatctggcaagttgattgatgccgacttaatcattaaagctcgccaagagttattaggaaaaggcgaataggaagatttatgcaaaaagtctacaacaaaatggcaggcgaaatgatgagccctcgcaatgccgttatccataaccaattagctatgcttgaacttgccacacttgagtgcgaagcattaggcattgaagtggaaaccgtcgaatggttcgatattggtaaaccccgccttgtcgtaaaagattgctcagctttgcgccatttaattaagactggtaaagcctttaattatggctcagaagtgaaaaacggcatccgtatttacctaaatcaaatgatggtaaaaggcgtaaaatttatttggaaatcagatgtaactaaacattaaccacaggagaaactatggcaacgaaagtaaaaagccaagcgaaattacgctttgtaagcgtagaacaggtgcaaagtgcgattaaagaaattggcgatttaagccgtgaacatacccgccttgcgaccgagatgaacgacaagattggggcaacaagtgaacactatgctccgaaattgaaagccttaaaagaagagattgagccattgcaaaaggcggtgcaggaatactgcgaggcaaaccgtgatgagctgaccgagttcggcaaaaccaaaacggcgaattttgtgacaggtgaagtgcaatggcgacaacgcccaccttcagtcgctattcgtggggcggaagctgtgatggaattcttgcaacgtatgggcttcgaccgctttattcgcaccaggcaagaaatcaacaaggaagcgttgctcaatgagccagaagtggcaaaagggattgccggcgtgacaattaaacaagggctagaagattttgtgatcaaaccatttgagcaggatgcgagatgatggacgatttacaagatgtaagcagattaagagaagcatatcagttttatcaaaaagcaaaacaagatgaagattcgattgtttgcggttgtttaaatgatgcgtatgaatggctcttcagtgaattgaaggcactgtttgatgaggaggaagaatagtgaaactaaaacagaaacttttaacgtttccaaacgtatgtttattgcttcttgtaatttgtagcacgctaggtttagcactggtttggtttattccatttgttggtcaagccttaatttggaattccctcgtttttctatgctgggtggtttatttcgaggttcgtggcttaaaagattggggcgaacacaatcttgagcaattagtaaagatggctgaagtttccgcagcagcagcttacaaaattagcagcatggtggcaaagtgataatgaatggtaaggagatgtaatgagtgcctctgtaatttgcttaatcgttgccagcgtactatcgcttatcgtgctgtatttagaacaagattaaagcctatttaaaagccctttaaaaatctcccctaccccctctttgcaaaagagggagacggattgaggggctttcaaaatatgttttaacccacaggagaaaccgatgaaaaccaaacgaccacacgccaaaagcgtggaaaacttcaaccgctaccgcttttatgcggagaaagcggcaaaagaagaacaagccggcaactacgaagaagccgaaactcattgggatttagcaatgctttctgccagccccgaaaacaaagaatgggcaatccgccgacgcgatttttgtcaacgtatgcatcaaagaccatttgagggggaataatgatgactgaaacccgtaaaaacgagctagaaaaccagctaaaccaaatgattgtgatgctaaaagaagctcaaaaatctttgtttaaagggcaatacacccacgcagctatttttgtggggaatgtgtcggatcagttgccaaatatgcgaatgatgttagcgagggggtaaagatgaatgcaatccaatttagatattttaaaggcgttatgactaaagagcctctaaaaacgattatcgacacttggtacaaattaagagctgaacgagataaaaagctaaccaacatatttaatactatccctttttatgaaagctggttaggtgatgaaacttctatttttggaatagtttgcagttatgacaatccagctcgtgatgaggcagtattaacaaaaggatacagaactgaagattataaaggaaaatgtgtggttaaacctgatagacgttataaggttggcaaggattttgacaaaaaactacaggctattcgacaaattttaaaggaagcccctgatttctcaagttattcgctaaaagagctgggtatgtatttgttagttggtaattttagccgactttatttctcagtatctggggttcaagatgatatttatatcgcaaaaattccagttaaagagcaaggtaattttggtgatgattttttagaaatccacgaatgcttaactgaaataaaagagagtgaatttctttctattcaaggcttataacaaggaggcaactatgtaaccgcacaataaccgctgcccacaccattccatctaggttgttataactcggtgtgggcaagtttaaagggtgtttaaattttaaagtaaatcgtttaaagcctgtttaaatcagctttaagccagttttaaaggattgactaagaggacacacaatgagcgaaaaagccaaactaatccagctgatccatattggcaaacagcagcttaatatggacgaattcagctaccgcgaaatggtcaagcgactgaccaataaaaccagctccaccaaatgcacggtggtggaactgctcaaaattctgcacgaaatgcagcaaaaaggggctaaagtgaaacactttgcaaaacgtgggacaaaaccaaccgcttacagtcctgctacaggcgaagttaaggtgaaaagtgaaattgctcataaaatccgagctgtctggattcagatgggtaagcacggatttttagctgacccaagcgnaaaagccttaaacagttatatgcgaaaagtgatgaacaaaggaaaaagtgtgcttgcactcaatgtaggggcgttaaacagcaacgatgccagcagatttttggaaattctcaaaaagtggcataagcgggtaatgcttaaacgtcttgctgaaaaatatgggtgcattacaagtgctgaaacaggctatgatgaactttgtttagtatttaaaaattatcagggggtagcatgaaactctgtcgttgccctatttgccacagtgatattcacttggaagcccttattgaagatgatgccggtcgtgaattattaggcaaaattagtcaacttacccacggttgtgcccaaccgatggttggttacttaggcttatttaagccagccaaaagcaacctcaacaacgcccgagctttgaagatattgagcgaagtgttagatctctacccttgctcgctgcttttggctcaagccctcagcgaaacggtggcaagcctgcgcaaaaaacgccaacaagccttgcaaactgggcagaaaattgaaccgctaacgaaccataattatttaaaatcggtgtatgagactcaaaaaccacactttgctgtgattcgctccggcaaaaatcagtcagaaaccgtcaaagcccaacaagcggaagacaaaaaagtgcaagatgcgattttatatgtcgaacggttcgtacaattagggcaagaagagtttgtgaaaaacagccctgaatatcaaatctggctgaatcataaggcacaaaaacaagccctttaattctccctcaaggcggtcattaccgccttttttcttgccttaaactcacccttttagacttttttatttctcgccagtcctttctatatcagctttaagccacttttcggcttgtattaagaaaaattgtgctagtgggaaattttaggttttgtacaataggcacattgataaattgaattgggtaagctatgtcgcaaacattacaacaaacaggattatttgatgatgaacacgctgatattggtgcattgttcgaccatttagaccaaatccccagcgtagagttagaaaaacgttggccatcgctattggtggaggtaatagaggtaatgcaagcggagtattgcgccaaaattttgcagaagataaagcaaaaaagaccgcttcgaagctcgtgggcgtaatggctcactattttggcggtaagtcgttttatctgcccgcaggtgataaaatcaaagaagccttacgagatgcacaaatttatcaagaattcaacggtaagaatgtacctgacctaataaaaaaataccgattgtcagaaagcacaatttatgcgatcttacgcaatcaacgaacgcttcaaagaaagcgacatcagatggattttaattttagttaggtggtcttatgaaattactcaaagcattagctgtattaagtttagcgacaatttcctctcactcatttgccgtagatgggtttcaaaacgtaaaattcggggcatctaaaaccgaagtaagaaatgcgtaccagaaatgccaatggcagaaagatgaatacgatcttttttgcccaaattttacattaggtgcgataaaagatactggagcatatttttattttattgatgataaatttgaacgtattgctattaacattccaaatgtgaacattgatggcatcggacaagctctaagtgaaaaatatactctttcatctcaaccgacacagagagaattagccaatccaaaaccgaataatgtgtatgactttggatttgataaagataccatcttaatccgatatacatatgacaacgatatgactgaagagatttttctcatttatactacacctgattttaacaacaaattacaaacaaaggacgcccaatcagttaaagatcaactctagtgtgatgactcacaaactcaccccataactcaatcccctaaactccagttattaaataatccttaataactggagttttttatgtctttacctatcaccaaaattgttgtgcattgctcggcaactcgcaacggcaaatccattaaacaaccaggcaaaaatgccgcacaagtgattgacggctggcacaagcaacgtggctttaaacgtcagctttcatcacaacgtgcatttaatccgcacctatcttcgattgttatcactttgtcattgatgtggacggctcagtcggaaccggtcgccaagtgggcgaaattggtgcacacgttaaggggcacaaccaaaattcagtggggatttgcttagttggcggtattaccgcaagcgggaaaaatcacggcgaatacaccgaagcccaatggcaatccctgtacaaactcttgcaagaactggaagcagaacacccgaaagcgcttatttgtggtcatcgtgatttatcaccagaccttaacggcgatggggtcattacccctaaagagtggctgaaagattgcccgtgctttgatgtgtggagctggttggatagcgagcaagtggtcaatcttgaccatctttacaaggagtaacaagcggtgggattttctgaactttttactaatgcagatggacgactttccactactgccagcmttcaattttggggcttcgttgctgccactggtgtgctgttgtactcggtttatttagataagccctatgtgccggaaatgttcagcacctttttatttgcctgtgttggcactgctgccaccaaaggtgtggcaaatgccctttcacaacggagagaacaaggaaaagagcaagggagagagcaagggagagagcaagaatgatgaatttaattttagccttttctggtgtgattgctttatatggtgggtatctctacctacgtttacgtcaaagccaaaagcaagcagccactttacaaaaagaaaaagaacagttgnaaactcaaaaaactgttgccgaaactaaagttnaaaattaccaagtgaaacagnaaaatgaagaaaaccttattagccgtagccgtactagcctgcttgagcggatgcacaacgatggcgacctccgtgattaaccccagttgcgcgggttttagcttaatcaaagccagcagacaagataccactgaaaccctgcgacaggttgctgtgcataacgccacctatcgccaaatttgtgaagaacaaccctaatggcagatgtattagaccaattaaatgagcgagaagaagccctcttacaaaacattctcgccccacatttagataccgaattgagcgatgatgaagtggacgcaattgccgaagctggtcgccaatgtagcgaatgtggcttgcccattcccactacacgcttgcgtgcgaatccattcgctcaccgctgtgtaagttgccagcaagattgggaggaaggacgatgattagcgaattttgggaatttgtgcgatccaattttggtgtcatttcgaccctgattgcgatttttatcggggcattttggctcaaactcgacagcaaatacgctaaaaagcacgatttaagccaacttgccgacattgcccgcagccacgataaccgcctagcaacactggaaagcaaggtggaaaatttgccgaccgcagtcgatgtagaacgcctaaaaaccttattaaccgatgtgaaaggcgacaccaaagccacttcacgccaagtagatgcaatgagtcaccaagtgggcttgttattagaagcaaaattaaaggaatgatgaaatgtcgtttaaagaattgattactcaagaccaacgccttgtggtattacgcgtactttccgaagccggctatgatgccaacgagtcgattattaatgatggcttggatttatacggtcacgatattagccgcgatttagtccgtacccatttgagctggttagaagagcaaggcttactcactattgaacgcctaaaagatggctatatggtggcaagtattacccaacggtggcttagatgtagcacaaggtcgtgtggcagtggaaggcgtaaaacgcccccgcccgaaaatttaaacaccgtttaaaggaggtttaaatgaatgacaaaaccacccgagggcgtgccagcaaggttgatttattgccgccaaacatcaaatccaccctcacgatgatgttgcgtgataagcaatactcacaagccgaaattctggaagaaattaacaacatcattgcagacagtggcttagatgaatcaatgcagctttccaaaaccggcttaaaccgttttgcatccaaaatggaacgttttggcaagaaaattcgtgaagcccgtgaagtggcagaggtctggacaaaacagttagtcgaagccccacaaagcgacattggcaaactgctgatggaagcggtgaaaaccatggcattcgacttaaccctcaatgccgatgaagccgtggcaaacgacccgaaatttttaaatcagcttgccctgatagccaaccgcattgagcaagcccaaagtattagtgaagagcgagagcgcaaagtgcgcaaagaagtcgcccaacaagctgctgataccgcagaaaaagtgattagtcaagcaggcttatctgccgatrcggtcgcccaaatcaagcaacaaattttaggaattgcctaatgcaaaccttacccgatttaatcccctttgacccaaatgccttactgctcggctatcaaaaacgctgggtggcagataccagtcagctcaaaatcgccgaaaaatcccgacgcaccggtttaacctgggctgaagcggcagatgatgtgatgattgccagtcttgccaaatcagagggcggttcagatgtgttttatatcggctctaataaagaaatggcacgcgagtttattgacgcctgtgcgatgtgggcagcccaatttaaccgtgcagcagggcaaatccaagaagaactctttaacgacgaagataaagacattctcacctacgtgatctactttgcttccggttttaagattaaagccctttcttccaacccgaaaaacttacgcggtatgcaaggcgtcgtttgtattgatgaagcggcgtttcacgagaaattggctgaagtgctaaaagcggcactcgctctcacgatgtggggtgcaaaagtgcggttgatttccacccataatggcgtagataacctgtttaatcagttgattcaagacagccgtgcggggcgtaaaagctattcggtgcataccatcacccttgatgatgcttgtgcggagggcttatatcaacgtatttgccaagtcagcaaacagctgtggacgcctgaaaaagaagctgcgtggaaagctggtctgttgcgtgaaaccgctaccgaagacgatgcactggaagaatactactgcgtgccaaaagccagttctggggcgtatattccccgcccaatgattgagcgtgcagcgaccgaaggcaaggccaaactgcgttttgagtgcgatgccaaatttatggaatggacggaagacgaacgcacagtcatcaccagtgaattttgtcttacccaactattaccgcacctgcaagccctcaaccctgaccgtcgacacgcctttggggtggattttgcccgcagtgctgacttaagcgtttatgccgtctgtgccgtacaacccgacaccgcacgccattttgacttaacgctggaaatcaaaaactgcccatacaaccaacaaaaacaaataatgctgtttatgttggcaaatctgccacgccttattggtgctgccttcgatgccaccggcaacggcggctatttagcggaagcagctttaattcgctacggcagcagtatggtcgaagccgtgcaactgaatgaaaaatggtatcgggagtggatgccgaaatataaagccttgtatgaatcaggttatattcaaattccgaaagatgaagaaatcatcttagaccacgggcatatacaggtgattaacggtgtgccaaaaattgacaaatcacgctcaaaagataaatcaggcaaacgccacggcgatagtgcagtggcgtattgtatggcggtgcgtgccagttatatgacaggtggagagattgatttcatacctctgcccgataaacattcagaccgcagcgaaaatgatgaatttgatgactttatatccaactgggactggtaaggataacgaaaatgcaaagtagaattttagatattcacggcaaccccttccgctttgaagctgatatgcaaaccgaaagcgaaagccgcttaatgccgctgcaataccattacagcgaccacccagccagtgggctaacccctgctaaagccgcacgcattttacgagcagccgagcaaggcgatttagtcgcacaggcagaactcgctgaagatatggaagagaaagacacccatattctttcagaacttagcaagcgacgtggcgcaattaccgccgtagattggcagattaagcccccacgcaatgccacgccagaagaacagcgtgatgcggaaatgttgcaagaaattttagaagatgcagtgtggttagacgattgcatttttgatgccactgacgccattctcaagggcttttccagccaagaaattgagtgggagcaaggcttagtcggcggcttaaaactgattaaaaacgtgcattggcgtgatcctgcgtggtttatgaccccagcttaccaacgcaacagcctccgtctgcgtgatggcacgcccgaaggggctgaaatgcaacaattcggttgggtcaaacacgttgcccgcgccaaaacgggctatttaagccgtatcggtttagttcgcactttagtctggccattcatctttaaaaactattccgtgcgggattttgccgagtttttggaaatctacggcttgccgttgcgtttgggtaaatatcccgaaggggcaaccgacaaagagaaacaaaccttactgcgtgcggtgatgagtattggacacaacgcaggcggcattattccgcgtggtatggaactcgaatttgaaaaagcggcagatggctcagacagcacctttatggcaatgattgaatgggcggaaaaatcagccagtaaagccattttaggcggcacactcaccagccaagcagacggggcaaccagcactaacgcactcggcaatgtgcataatgatgtgcgtttagaaattcgcaatgccgacctaaaacgccttgcagccacccttacccgtgatttggtctatccactttatgctctcaactgcaaatcatttaatgacgcccgtcgcatcccgcgctttgaatttgatgtggcagaaagtgaggatttaaacgcttttgccgatgggctaaacaagctggtcgatattggcttccgcattccgaagcaatgggcgcacgataaattgcaagtgccaatcgctactgaaaatgaagaggttttggcaaaatcttttcaaaatccgaccgcttatatgcacagcaaagctgacggaaaaatggcagtattatcggtgcaacccgacccagaggatttgctggataacttagaacccacggcggaagattaccaagccgttatcgatccgctattgaaacccgtggtcgaagccttgcaaaaaggcggctatgaatttgcacaggaaaaactagctatcctttatgctgaaatgaatgatgaagagctggaaactttgcttactcgtgcgatttttgtcagcgacttattaggacgtgccaatgccaaacgataacaacacgccacccgatggcaacgacattgatatgggctatgtctacgcctagagccaaaactggctgtcgattacctcaaatcaaaaggcgtgaatattacttggaactggtacgaacagttagaaagtgcgcacgcccgtgcatttaccgtagcaaaagccactaaagcggaagtgttagataccatccgctgggcaacggaacaagcgattgccaacggcaccggtgagcgggaatatatcaaaaaacttgagccaatgctcaaggaattgggctggtggggcaaagccaaagatgaaaatggcaacgaagtgcaactcggtagccctcgtcgcttacgcaccattttacgcaccaataaaatcaccgcttaccacgctgcacgttacgctcaacaaatggaaaacgtggacgaacagccttattggcgctatgtagccgtcaatgacagccgcacccgagccagccacttagccctgcacggtaaaatttatcgtgcagacgaccccatttggcagacaatgtatccgccgaatgattggggttgccgttgccgtgtggaagccctgagtgaatatgccgtacaaagtcgtgggcttaaaatttcaagcagcgatggcgaaatggaaatggaagaagcggtggtcggcattgataaagacactggcgaagaaattcgcaccacggtgagcaaaatcaaaaccgaccaaggcgaaatgaaagtgggcgctggttggaactataacgtgggttctgccgcctttggcactgatgtggccgtgttgcgtaaattgcaacaggtgaaaaatcgggagttaagacagcagactattcaggcgattaacaacagcgaagcacgccataaagcctttgccgattgggtgttggcaaatttgggcaagcgaggggcaagtgcaagatatatgtcggctgggttagtgacgacagaaattgcggaagctgtaacagaaataacccaaggcggaaaaaatgcagaattggttttagtaatgtcagaaaaacgtttggcccacgcaaatagtgataaacatcacgaaggcggtgtcggactaacagctgaagagtatgcgtctatttctcgcattgttgcaaatccaagccttgttttatgggataccctagaggggcataataatttgatttacatcaatcaagaacgaactattcaggtaattgttgatgtgccaaataaacactcaattaaacctaaggaaaaagtagatgcaatcatcaatgcttataaagttgatatgaacaacgtgaaaagacagctttcaggtgggaattatgtattgcttaaaggaaaactgtaagtgttatggtgggggttgaacccacgatatacatatgccattaaagaatgggaatgccgcgttaccatttcgccacataacactcacagttttagttctgttcaatttacgcccaaatatcaggaaagtcaaattatatgcacattgaatataaattcgataccagcactattcagcagaaatttaaaaagctagcgcaggtgatggacgggcgagatattactcgcaaagtggctggcgtattacgccaagaagccgagaaattctttgatctagagcaagcccccacgggtgaaaaatgggaagacctagatgaagattacaaaaaatatcgatacgcagcaggtcacactggcaaaattttacaaatcagaggcggaagaggtttggctggtagtttaagtttagattatggtgataattatgctttaattggtgctgctgaagagtatggtggtttccatcaactcggaacaacatttatgccggcacgtccattcttagggctaggcaaagacggcgtcagcgaaattaaagcgattttaaaccgagagttgtcggaattaactcaagaataggctaaaatcgcaaatatcgccacagaatcacgctaagggcgtttgaaaatcaatttatatcattttacgtctcaaaaaatttaaacgtgcttaaacgcatttaaacggcatttaaacgctattctaatttaaacctttctctaattttccaccgctgactttcagcgttttattttaggctgatatatcacaaatccgcccttccctccctttaccgcaaaatagcggttatgaaagcagaaaaaacctctttagcggtactcaccgcccaacttaccagccccgacggttggcagcaacttctccccaagggcgaatttcgctcacgggacggctcgcccaccgacgtggcgcattggtttattgatggaacgattgcccaaaaccttatccacaaagcccgacagcttaatcaagatttactcgtggactacgaccacgaaacgattttgaaagcgaaaaaaggcattgacgcaggcaacgtggtggcagcgggttggtttaatgccgatgaaatccaatggttcgatgatgaaacacggcaaggcttgtacatcaaaccccgttggacgccaaaagcctatcaacaaatcaaagatggtgaatttgcttttttaagtgcggttttcccctatgacgaaaacggcacgcctcttgaactccgaatggcagccctaaccaatgacccaggcattactggtatgcaacggttagccgtgctttcggcaacccttaacccacaggagaacgtcaaaatgcctgaatccttacgcaaattactggcaaaactgggtgtagaaatcgcagaaggtgtagagctaaccgaagagcaagccaacaccgctttaaatgcccttgaaaccttgcaaaccgacaaaaccaaagccgatgagcaagtggcaactttaagtgcaaaaaatactgaagtggatctttcccaatatgtgccaaaagcgacttatgacgcggtaatgagccaagtggcggtgttatcagcaaaaaccgatgatgtagaaatcgacaaccacatttccaaagcccgtaacgaagggcgtgcagtggaagccgaagtggaatacctcaaacaatttggcaaacaacaaggtgtggcagctttgtctgcaatgttggaaaaacgcccacaaattgccgtgctatcggcgcaacaaacccaaaccaccaaggtggaaaagcctgttgaaaaaggcactgccgtgttaagtgctgccgataaagaagcagcgaaattattgggtatttctgaacaagattacgcaaaagaactggaggcgaaataatggcaaacgtaacccctgatttagtcaaagccctgtttgtcggttttggtaaaaactttaaagacgggttggcaaaagccccgagccaatatactgaaattgccacagtcgtgaaatccactaccgcaagcaatacttatgcgtggcttggtcaaatgccagggctgacagaatggattggcgaccgcaccttaaccgcgattcaaagccacggctattctatcgtcaataaaaaatgggcaaacggtgtagaaatccaacgcaccgatattgaagacgacaacgttggcgtatatagcccattgattgaagaattaggtcgtgctgcaggtgaaaaagccgatgaattagtcttcggtgcattaacggcaggctttaaaacagcgtgctacgacggtcaatacttcttcgataccgaccaccctgtgggtgcgaatgtcgatggtactaaccagaaatcggtgagcaacattaccgatgacagtacaggcgtaacagaagctaatgcgtggtatctcttagactgttctcgcagtttaaaaccgattatctaccaagaacgcaaagccccaacaccggcacagattaccgatgccaacgatgaaaaagtctttatgaaagacgtgtttacttacggtgtggattctcgctcaaatgtaggctatggcttctggcaaatggcacacgcggtgaaaggcaagctgactgcggaaaatctctggaaagcgattgaagcgatgcgagcggtgcgtggtgatggcgataaacgcttggcaattcgtccaacgcacattgttgtgccaccttctcttgcgcaagcagcaaccaagttgcttgaacgcgaattgcgtgccgaagatggtgtagcagtcgataacgagttcaaacgtatgaacttgaaattgattgtgggcgactacctctaatcaactacaagcggtcagatttgccaaatattttacaaatttgaccgcactttaaacctgatttaaagaggatttaaatgcgatggataaaacattttgtgttgtggtgcaaaaccggattaaagaaggctatcgccgtgctggtttcagtttccaccttggggacaattcgcttgcagctgtgtcagaaagccagctcgcccagctcaaagccgacccacgcttggtggtacaaatcaccgaaacaggcagtcaagaaggtggcgaagggttatcaaaagagctgcgggtagtgacgaacagaaacaacttcgtgctgatccaccatcaaccgatttaaacactttcacagtggaacagttaaaagcccaactcaccgaacgtgggatcacctttaaacaaagtgccactaaagcggaattgattgcgttatttgctcccgccgatggtgaaaaaagtgaggcataacgatggtgttatatgccaaccgtgaaagcctgattaarcgttacactctcaaggtgcttgagcaaatcgcttggctacccgaagsgcaatcgctggacgaagccaaagtgcaagaagccttagaagacgccagtcaaaccatcgacagttatttgggtggtcgttatgtgttaccactcaaaactgtaccagcagtgttagaacgccattgttgctatatcgctcgatactttttagagaaaaatcgcgctaccgaccaggcccgtcaggactatgaagacacaatccgttttctggaaaaagtcgccagtggtgcgatttctctcggtttatcagacgatgatgaaacggtagaaagcgaaaatggcgcaatgatggaaagtgctggcagcgtatgggggcgcaatacctcaaaagggtttatctaatgagtgtcattgctgaaaccaacgaggcactacttgctaaaatcaaagccctgtgtggggattatctgcgtgaagtcgatacccacccaggacaatgggatgacagttcagtccgccgtttagtgcgtaatccgcctgccgtttatgtggcgtggttggggcaacagcccaacaataatccccacacagtgaccgcccgttggggggtgtttgtggtggctgaagtgttaaacgggcaacgtcgcaatgccgtcggtatttaccaaattgtggaaaccctcaccgcagggctacataagcaacgcattgcgcccagcggtatgtttgaattgcaaacggtgcaaaacctgtggtcagatacccaaagcggaatgggtgttgcggtttatggtatgtactttaacgccgtgcaacctttgccggatatgacaagcgatgacaccttgtgtgattttaaaatttatgatcacaccttcaaccaagataaagatgaacacacgattgacggcaaaacccgcctcacagtggaattgccaacgcaatcagattaaacagggggcaatatgccaacatttaaaattaagcctaaaacaggattgctgattcgagacccagagacctttgagttgttaagcgaaagcggtgaagataagcccaaaatcagctactggctcaatcatcttaaaaatggcgatgtggagctggtcacagaaaccaccacaaaagccaaaaatagcaacaaggagcaagcctaatgtctatttctttcaataatattccgtccgctttgcgtgtgcctttaacttacattgagtttgacaatactaaagccgtgagtggtccccccaccgccttgcacaaagtgttgatgttaggcacaaaacttgccacaggctcagctaaagctggtgaagcggtgcgcgtgtcagcgtatgcacaagccaaaaccctatttgggcgtggttcacaactggctgaaatggttaaaacctttaaagcccacaacagcacacttgatttatgggtactccctcttgatgaagcgccaagtggggcaaaagccacaggttctgtgcaaattaccggcaccgcaactcaagctggcacttttagcctgatgattgcaggtaacaactacaaaaccgctgtgaccagtggcgatacagcagatgtggtcgcaggcaaactgcaaaaactgattgccgcagaccaagatgtgccagtggtagcaaccgtcgcaggcaacaccattacgctcacttgccgttttaaaggcgaaaccggcaatgagattgatctgcgctgcaattactactcaggcgaagccttccctgaaggattaaaagccactatcactgatatgaaaaacggtgcagtcaatccggatatgtcagtggcaattactggtttaggcgcagaatggtggaactacatcattaacccgttcaccgataccgaaagcctgaatttactgcgtgccgacttggtaaagcgctggggaccattaaaacaaattgacggcatctgctttatggcaaaacgtggtacacacgcagaagtcaccacctttgctgagcaacgcaatgactatttgttcagcttgcttgctacccataaagccccacagcctgcctatctttgggcaagtgcttatgctgccgtggttgcaggctcgcttgctatcgaccctgctcgtcctgtgcaaaccttggtgatggatttactgccaccgagtatgtcagaccgctgggacttaccggagcgcaacacgcttttgtatagcggtgttagcacctatacggtcaatgcaggcagtcagccacaagtggaagcagcaatcacgatgtatcgtaaaaatgcctttggcgataacgatgaaagctatctctatgtggaaaccatagccaccttgagttatttacgctacgccattcgcagccgtattacccagaaattcccacgccataaattggcgaatgacggcacacgcattggaccggggcaagcaattgttacgccaaaaattattcgtaatgaactcttggcattgttcactgagctagaatttgccggcttagtcgaagactttgagcagtttaaccaaaccctctttgtagaacgtgatagcaataatccgtgccgcgtgaatgtgttatccaacgaaaacctggttaaccagttccgcatttatgcacacgccattcaatttattttgtaaggagcaacaatggcaacacaatttcaaggctcagcaattattcgcctcaatgggaaagaatggccgtccgacaacgacggtacgctcaccccaggtggcaaagagcgcgaaaccgtcaaaggttcgcgtgtctatggcttttctgaaaaacctactgaagcaatggtggaatgtaccgtgtttaactgtgccgaaaccgatgtgatggaattacaaaatatcaccaacgccacagtggagtttgaaactgacattggtcaagtttatttgctccctggtgcatggacagtagagaccggcacgttaagtgcggacggcaaaatcaagctcaaaatggcttcgattgaatgtaaacgtgtgcaataagggggaatcaaaatgaaattgatgttagaaaccggcttaatgtttggtgaagaagcccaattagaagtaacaatgcgtgaacttaccacgggtgatttactcgatgctgaaatggcagcagaacgtttagtgatgacccccgagggcgaggcagtgttagccaaatcccctgcgttattcggctatgagctsstccgccgtcaaatcgcttcagtaggcaaaattaacggcccgatttcgatgcgtcagttacgttcgctcacgaccgaagatttaaaccgcatcagcctttatgcgcaaagctgggagtcggccaaagcagaacaggtggtctcgcgggggcgattggatacagcagatcaggaaactggaaaagacctgtctgctgttagctaagcattatcagtgcaaccctgtgtggttgctttctcaacctatctttaacttgccacgctatattggctacataggaggcaatgatggcaaataactctacctcgttttttgtcaatctagcgggcaacgtctcacaacaagcggcacgatttagcaattcgattgccaatatggcaaacaaaaacgtgagcagcctgaacaaggtcagtcgtgctatttctgcggtttccaagggctttaatgggctgggaaacatcactatccctatcattggtgtcggagcagcagctggtgcgaccatggtcgggaaatcaatgttgcgtaccgccgctgatttcgagatggcaaaaatccgaatgaagcagacctttggtgagcaaggtgaggctgccgatgcgtggcttaaaaaattcgctactgataccccaatggcatttgccgacacccaagatgcaatgatgcgtctgaaaaccgctggcattgacccgatgaacggttcattgcaagcccttgtggattataacgccaaagtgggcggcgataaggcaaacctagacggctatatctcggccatcagtaaaggttttatcaaaggcaagctttccatggaagaaatcaaccctttgcttgaacgtaatgtcaaagtatttgaaatccttgccaaggaaacaggtggtaaatacaccgcagaccaaatgcaaaaaatgttacaggaaggcaaactagggcgtaaagctatccatgccttattgcgaggtatgggacgcgatgctcaaggggcagccaaggaacagatgaaaacctgggacggtttagtatctaaccttgaagatacttggacgtcgatgcaggcacgctttatggaacacggtgcttttgatgccttgaaaaaggaactaggcgattttgttgagtggcttaacgaaaaaattgatgatggcacacttgatgattttccgaaaaccgtcagcgacacgctgattgaagccctaaaaaacctaaaagagatggcaaaagacgtgaagcctgttttagagagtatcggctcggtcatgagctgggtctctgaaaaggctggcggttacggcaatttagccaaatttatgggagccttatacctcggtaataaagtgctgcgtaacgacaaagtgcaaacgctaggcggttggggctggtcgggagctaaatggggttataacaaaatcttcaaccgtaaaaaaggcggcgcaggtggtttggctgatggtgtggcaggtgcattaggagctaccgtaggcgttacccctgtttatgtaaccaacttcccgatgggctttggtggcggtggcggtggtggttatggttacgatgtcattgaagatgggcgtgataaagataagaaaacccaaaagaaaaacaaaccaccaagaccaaaacgaggacgtggtagtgtgcgttcccctgttgcagcagtggcagcttctgcggctgccgtgcctaaggttgctgcacctgttaccactgcctcaagcggtgtggcacgttccgtgggcaatggcgtgaaatctttagggcgaggggcatcaaaagccgtaccttacctaggaacaggtttggcagtggcagaaggtgtcaccgtgttgatggacgataccaccaacaccaaagagaaatctgaggcgattggttctatcgcaggtgccactgctggggcgatagtcggacaagccctgattccaattcctgtagttggagctgcagtaggctcttatttaggtggttggctcggcgaatggttaggctccgaagtcggagagtatctttctgatcctgaaccgattaaaaacgagctaaacggcacaattaacattgcggtgaaagcctctgaccaactcattgccacggcaacgcaagccaaaatacaaaccaatcaacaacgggatagcttagaaacagcagtgcaaatgggaacattaggcatgggaggtatgtggtaatggcaagtaagattacaggtaaaggtagctttcgtggtgtgccttttcttattgaagaagagcaaggcttagacggaggtcgccgtattgtctcacacgaatatccgttgcgtgatgagggtttaaccgaagatatgggcaaacgcctgcgccgttatcaagtctcttgcttagttatcggtgacgatcacttagcacaggcagaaaaactgattgacgcccttgaagccagtggtgcaggcacgctcaagcacccttactttggcactattgaggtgcgggtggacgactaccgtgcgaaaaactcaaccaaccatcaaagggttacgcgttttgacatcaattttctgccggcaatcgaaaaaaatgccccagaaattgccgaagacaccgcttattcggtgttgtcggaatatcaagcaaccctcaatagcctgtcggacgaatttgccgaaatggtgcaagatgtgtcgggttttatcgaatctatggtagataatccactgtttcgccttgctgatactaccgccgcatttatcgaaaacatctttgagggcgtggcaaatacggtgagcggattaacagaagtgaaagacaaagccttgtcgattaaaaaccgcttgagcaatctgcttttaacgccaaaagtgttggcatacgaactgcaacaactgacaagactgaacgtgcgaagtgcggtcaattcgcaacgacaatttgtacaacacattgtgatcactgattccatcagctcagcattaggcgatttaactgcgactaaaaacgaaatcagcaaaagcacactggacgaaatggtgacagccaaaaccaacaatgtggctgaaacagaaattttagcccgtcagtttaaaaacttacacgagcaagaaatttttgatgccttgatgaacaaaaccacgtttttattaaaacgtttagtactttctacccttgcggtggaatatggcaaagcgatttctgatgcggtgactgagtctgtggcacagaaaacggtcacggaagagacaatcgccactctgattgaatccaaaaccgatgtgcagcgttacattgctgaggtggacgaacagctggaagcggtcattttagacaacgccgatgcagaacagtggacaagctacgcagcccttgagcagtatcgcttaaccttaatgcgagatttacaaatccgtggcgagcgattggcaaatgccattgaagtgaagttaaacgacacttaccctgccattttgctcgaataccgccacaccggaaacagtaaaacgtggaaacgcttggcgctgcgtaacggtatttcgcacccgctcttttgtttaggtggcactaccttggaggttttacagtaatgccagatacaaataacacagaaaccaataataagatcgaactctatctaaatggcaaaattttatccggttggaaaagccttaacctgcaacgctcgctggaatcaatgagtggtcgttttgatttaggcattgctgtgcgacctgaagatgatatatcagtgcttgccgcaggttcgccactggtgctgaaaatgggcgggcaaaccgtgattaccggttacttggatgaaatcaaacaacgcgtaagcggtaacgacaaaactatctctgtgagtggacgagataaaacttgcgacttggtggattgtgccattatccacaacagctaccaattcaaaaaccaaactgccaaacaaattgccgaagccatctgtaaaccttttggcattagcgtagtatggcaagtgcaagcccctgaagccaatgaacgaatccctgtctggcaagtagaaccaggcgaaaccgcctttgataatttaagcaaaatcgcccgacacaaaggcgtgttagtcaccagcgacgtggacggcaatttgcttttcaccgagccgagcaacaagcaagtcggtaatcttacccttggcgaaaacttgctcgaactggaacaaaccgacagctggttgcaacgcttttcgctctatcgcgtgattggtgacgcagaacaaggcggcgccaaaggtgataccaaaaccaaaaacaaagcggcaaaaggcaagaaaaagatgatggcgtggtagaagatcccgatatttacccaggaccagcagaaggaggcaagtaatgagtgcaagcggtttaaaagtagaagtcaatgacgaagccatcaatcgttatcgcccgatgattattattgccgatgacaatatgaccggctctagcggttatcaacgtgccgactgggaacgcaaacgtcgccaagccgaaggcaaaaagccacagcacgagtgcaaggttggtttaagcctgacggcacactgtggctaccgaatgaactggtagtactcgatgccccacaatttggcatacacaaggctgaacgcctgattgtagattgcacttacaccttagatgagaaaggtaccattactgaaatgaccttaatgcaccgtgatgcctttgatgaaccagctgatgacaccttagacgataccaaagacagcaaaggcaagaaagacaaaggtaaaaaaggtaaatcgaaaaaggcgaagaagtctgataaagacaacgtgtctgaatttactggttttttagactaatttaaacgagatttaaacaggatttaaaagaggtttatgcaagcaataaatcgcataattgccccacttaaacgagggctacaactactggtcagccgtgcggtggtgtcagtggtgaatgatgcctacgcacgccaaaatctccagctacggctgcaatcagaagaagtggccgatgatgtggaacgcttccaaaactacgggcattattctgtgcccaaagccggtgaagccattgtggtgtctgtcggcggcaaacgttcccacttggttgccgtggtggttgatgataaaagcgtgcgtcctgccggcttgattgctggcgacagcgtgttgtatcatttagaaggtcatcaactgcgcttaaccgaaaatggtgaagcgatcctctcgtgtaaaaaattcactatcgaaaccgacaccctcgactgttccgcacaacaaatcacgtttgatagtccgcaaacgacctttaccggtaacgttgatattatgggaatatcaacagcaaccgaccaccagtcaagcggaatcagcggaaaaaaccacgaccacgaagaacgtgtgggcaaacctgttccgtaaggagcagtatgtcagatttagccctaacatggcataacggcgaaggcgacttggtgctaggcactgagtcgcttttgcttgatgatagccttaccaatgccattatcattagcctgttcactgatttgcgcgtggagggtgaacgtggctggtggggtgatagctataacgatggctttcaaaccggctcaaaactttggactttaagccgtgccaaacaactccccgaaatccttgatgacgcgcaactttacgccagccaagccttgcaatggctagttgatgatggcgtagccaaaagcgtgcaagtgattgcctccaatccgcaaatgtcggtcttgctgttagaaatccttgtggtgttgcccgatggcagcacagaacaacgcacctttcgtgcaaattggagtctctaatggcatttaataccccgacactctctaccctgattaaacaaggcgagcaacagtttcaatatcgcttcccaacacttaaacgacacaatgtgattggcgtgattaaccgcatttgtgcagcattaagtgccggcgaacatatgcacttggactggctcgcacgccaaattatccccaccaccgcggaagaagactatttaatcgaatactgcctctataaaggcattgtacgcaaacaagcctcaaccgccacgggattagtgactgtgaccgcagccaacgacactacaatccccgcaggcacagtgtttgaagataccaacacagggctgacctttatcaccacccaagaaaccgtggtaaaagccggcaccgctgatattgcggtgaaatgtgaaaccacaggcgtagaaggtaatttaaaagccggtacaagcctttcactgacctcggcaattttgggcttattgcccaccgcaaccgtcaaagtaatgagcggtggcgcggacattgaatccctttcgcgtttattagcacgcctaatttatcgggttcagtacccgccagctggtggagcatcacatgattatatacgttgggcaacggaggtgcctggtgttactagagcttggtgtttcgaacgctattatggtggtggcacagttggcgtagcatttgcttgtgatgaacgtgaagatattttaccaacgccagaagatattgcccgtgtgcgtgcctatatcgaaggacataagaatgaagtaacaggacaatttgaaggcatgccagcaaatgtagaactgtatgtcttcgcaccacagtttcaagcggtcaattttaagatccgtcttgcacctaatacgccaaccttacgccaagcagtacgtaaaagccttgctgcttatcttgccaacgctggcgtgggggcgttgctctatctttcgcaaattcgtgcgaccgtttccaacaccgcaggcgaagtcgataacagcgtgatttttccaaccgcagatgtgcaattgttaagcgataacatcgctatcctaggagacatcgaatggctatgacccacgccagtatttagacgcggcgataaaattgctcccagtagggttagcgtggaaacgagcgttagacagcaatcttgccaaggtgcttgccgtgcgttgtgaccaacttgtagaagtcaatagcaaagctcacaccctcatcaaagagcgaatgccggggcaagctacattgttacttgaagaatgggaaggattttacggcttgcccgagtgtgggcggcaaattgtagggaaaacgctagtacaacgacaaaagcaagtacaggaaaaagagaatgaagtggggtcaaatagcaaacggttcttagaagagatagcaacccaagctggatttaaagtcagagttgttaaccattatccacaccattgcttgcgagattgtacctacccactttatgaacaagcaaaccattggcgcatttttatgtacaccccagcagtatcatctattaggtacgcaacttgtttagatgatgtggtgaaaaatttaaccatatttgagcgtaataaagagctagagtgcttgttaaaacgttatcaatacgctcatttagaatttgtatttatctatgaagaggaaactcaataatgtatcacttagacaatgattcaggggtgtcaacgtttgccttggcccccgttaaaagcacacagcgtctttggtttaccgaaggtggtcatggcaatgctatcagttatcctggtgctgactggtttaatatggtacaggccgaattgttctctattttagatgatgccggaatccagcctgataaggggcggttgaatcagatttcacttgctatccgtaaattatcagaaggtaaagttgaagattttagccaacaactcaaacaagccgatggttataaatatatcggtcggtgtaagtctgttgctgagttgcgcactatccgcccaactgaaaatgggcaacgcattttggtagatgcttattatgaaggcagtactgcaggtggtggagagtttgttgcggatttacaagacctaattacacctgatgacggtgggacatgttttgtagtaccgaataatggtgggcgctggaagcgattgttctcttcatcattgcaagataccgatttcggcgtaattggcggcgttgctgacgatacaacgaatttaaatgcgtttttagatgcgttgcggacatataaagttaaaggctactttacttcacgccactataaaacctcagctgcattaaatattgcgggggtcgatattgaaggggttctagctggttataaaaacaaacacggcacgcgaattacaggtaacggtaaccacaatatctttgagcaaatggggggggaattacaacacattacttactcgcttaaaaattttgcgttaagcggtggcattgttgggttgaaaatgacctatgccgtcaatgcagtggttgaaaatgtatttattgacaatgtagaacgtgctttcttgctgggtgactcacaattcgtcggcccgatttggtgcagcctgaaaaattgccgtggtgaaggtcgcatctctggcttggagattgatggcaacaaatgggcaaacgctaatatgtttgaaacttgctttttcaaaggcgacgaatttgccggcagtattacggcaaaaggcgggattggagcagtctcgaaccattttgttaacaccgaatttgctggtaaaggtgttggtgtcaagctcgggaaaaacaagtcgaccgcttttgacaactgctattttgagagcgaggggccatccctactcatcgaagattcaaccgcagatttagcattgaacaatgcaacatttggaagtttaactgaaaataataagacggggaaaacatcgtttatccatcactctttaggcacttgtaatatgtctatttcgagtgggtatatttatctcgctggcaacaatcaaaacaacttagcatttattgagagtgataagccggaatctcttgtggtaaatatggcgacaccagtaaaacgagaaatatatacggcaactggctttaaattattcaaaaatcctgatttaccaaacaaaaattcccgggtgcactatactagtgggtatgtttgtgagttttctagccagaacaaaaatgcagagcttggtaatggtgatttaacagcttattacaatttaaataacagtcgttgtgctgttggattaaatttaaaaattggttcaagcacaacaaaaggtacagggcaatggcaatttcgtttaccattccaagctagtggaattggcaaatactacttgggtcaagcaatagccataaaagctgatggtagtaagttaatgacaggtgtagcacgtattgtaggagggtcaaaccaagttgtagcttattttaataatgttaatccagctgatgctacacggccgttcgaatggactgaaggtgaccgattagatatttcgattgagtatgagatttaaaaatgccaaagaaacactactgtacaggttggcgaaaagcccctaccaatatcaatagttgttgccaccaacacgaccgagactacggcatacacggcacaatcagtcgcgctgatgcggataaacgtctaagagaatgcttaattgcacaaaggtatccattcaaggcatggatattttgggtgatagtacgattattaggttggatattttataaggaaaataaactaagccattaaaacaacgaaaaaatatcagggttttatattctcagtttttgaaacgtaatattgaacgaattagcaaatttgataaaaggagggtttacctcgcacaaagtttaaaaagaaaagacggcgataataacggcacggcaatgcgcgttattaccagctacgcagaacatgcctgcatatagccatacgccgcctaccttgcgcaaggcgggcggattgtaacaaatcttttaattatggagaatatatgcagtcaattaaaacaatccgttgcacattttgtaacaaattattggcgaaagtaggtacagttggttatttagaaatcaaatgcccacgctgcaaagtaattaactttactaaataactttatttgagtgtcggaataccttgagtatcagaacgccatagaaggaaaaactatggcaaacaaaaaaacttttaaacaagccccgctaccgtttatcgggcaaaaaagaatgtttttgaaacacgtggaaattgtgttaaacaaacacattgatggagaaggtgaaggttggacgattgtggacgtatttggtgggagtggtttattaagccatactgccaaacaactaaagccaaaagcaaccgtaatttataacgattttgatggctacgccgagcgattaaatcacattgacgacatcaaccgattacgccaaattatcttcaattgcttacatggtattataccaaaaaatggacgattaagcaaagaaattaaagaggaaatcatcaataaaatcaatgatttcaagggttataaagacctgaactgtttagcttcttggttattattttctggtcagcaagttggaagtgttgaggcgttatttgctaaagatttttggaattgtgtgcgccaaagcgattacccaacggctgagggctatttagatggcattgaggttataagtgagtcgttccataagctaatcccccgctatcaaaatcaagataaggtgctactattacttgatccaccttatttatgcactcgccaagagagttacaaacaagccacttactttgatttgattgattttctacgcttaatcaatctaaccaaacctccttatatcttcttcagcagcacgaaaagcgaattcatccgctatttgaactatatgcaggagagcaaaacagataactggcgagcgtttgagaactataaacgaattgtggtgaaagcgtcagcttccaaagatggaatttatgaggataatatgatttataaattctaaatttaaacgctctctaaataccgtttaaacatataaatgagccattaaaacaacgaaaaaatctcaaggttttattttcgtagttttaatggttttttttcgcagttttaatggctcgctacaacgcaataaaatcgaactcgcaatataagtctgagcaataatgatccctacaggggaaaaaatccatttacttataaaaggaagtagttcagccaatatcccttgtgaactaaaaagtagaagcaaacttagtcctgtgactaatggtggcaaaaccattggtaaatcaaacaaagtgtcaaaaaatgattgaaaaggcaaccgcacttgactcattcgccatgcagatggaatagcaatacataatgctaatatcaaagaaaaaagagacgttcccaatgacattagcaatgcaaaatgcaattcggaattaaataatatttgttgaaaaaaataaaaatctaattttgcgattaaagaaagcaccgatcccataacaacaaataatagtattaataatgggatcagcgctaactttaaacttagacaattatttagccggtaagaaaccttcatcagtaaaatacttcacgccttgaggagatttaaagaaatcaaataactgttgagcttcttttggatatttagaagaaaaaagtagaccaatagtaactttttcttctggtgtgccttttggacttggtaataattcaaccttgtctcgaactttccaagcacctgaacgacctactacagctgcatctacatcaccatttaataaatatagcattaattgttttaccgtcgcagctttcacaacaattttatcattaagttgcttttgatatcctgacaactcaaacattttttcagcgcctttaccaagagccattgctttactatcaccaatacctaaacgtaatgagctttcagctaatgctttaaaagaatcaatccctgaaattttatctttacgaatagccataactggaacatgcaatactatggtccctatattgtttacatcattagttttctgtaattttgtgacataatcctctgaacccgctaaaaaaagatcaccactttttaccgtgttataacgagctagaatctgtccagaaccaccatattcaacagttactttatttcctgtttcttgttcatattggtgaataattttttccacaggctccttcagtcccgccccagcatataaatacaagtctgcagcttgtacagaaaatgtagttaaaatcattgaagttacagcaactaattttttcattttctctccttataaaatgagtttcagcgaaaatcgatatatataaaattgtataatgaattattcgaaagatttattcaatctttagtttataaattaatcgattttttttctaatttcatgacatggcactaattgacttaattttgaaacaacaaaaaaggttgggactccccaacctttcacttaatctttcaataatttaattttttcaatcacatttgttgttgaacaaccattttcaaagtttagcactttaacatcgccaccgtttgcccaaacttctttactgcctgcaatctcttcgggtttgtaatcgccgcctttgactaaaagatctggtagaatttcgccgattaaacgttgtggtgtatcttcagtgaaaggcaccaaccagtctacggatgccaaaccagccaataccgccatacggttttcaagattattaattgggcgactttcaccttttaagcgtttaacagaatcgtcgctgtttaccgcaacaattagacgatcgcccaatttgcgtgcattttctaaataagaaatatgccctggatgcaaaatatcaaaacagccattagtcatcacaattttttcaccgcgcgctttagcttgtgcgacagcatcttttaattctgcttcactcataatgccaaatccagtttcaggacgagcatgaatcgcattttcaagttccacggtcgaaaccgttgaagtccccaatttccccaccacaattcctgcggcaacattggctaggtaacaagattcttcgaaagaacgtccatctgctaatgcggttgctaatacgctaatgacagtgtcaccggctcccgtcacatcaaacacttcttttgcaacagttggcaaatgataaggctcttgatttgggcgtaataatgtcatgcctttttcagaacgcgtcaccaaaagtgcggttaattcaatatcagaaattaattttaaacctttctcaataatctcttcttccgtattgcatttacccacaacagcttcaaattcagacatattgggtgtcaataatgtagccccacgataacgttcaaaatcagttccctttggatcgatcaacacaggcacattcgctttgcgtgcaatttgaatcattttctgaacatctttaagcgtgcctttgccgtaatcagaaagaatcaaagcaccgtaatttttcaccgcactttctaacttcgctaataaatccttgcaatctacattattgaaatcttcttcaaaatcaaggcggagcagctgttgatgacgagataaaatacgtaatttagtaatggttggatgggtttctaatgcaacaaaattacaatcaattttttgtttttctaataagagggaaagtgcagaaccagtttcatcttgtccaatcaatcccattaactgaacgggtacattgagtgaagcaatattcatcgccacatttgctgcaccacccgcgcgttcttcattttcttgtacacgaaccactggtactggtgcttctggtgaaatacggttggttgcgccgaaccaataacgatcaagcatcacgtcgcctaatacgagtacttttgcttgcttaaattctgctgaatattgagccattttaaaatctctctatttgaataaccaaaattgtggcgattttaccacaactcaaatttacgataaactacgcccctaacttacgtggaaagaacaatgaaaaacgaaaaactccctcaatttcaaccgcactttttagccccaaaatactggcttttttggctaggcgtggcaatttggcgaagtattttatgtcttccctatcctattttgcgccatattggtcatggtttcggttggctgttttcacatttaaaagtgggtgaacgtcgagctgccattgcacgccgtaatcttgaactttgtttcccagacatgccagagaatgaacgtgaggtaattttgcaagaaaatctccgttcagtaggcatggcaattatcgaaactggcatggcttggttttggtcggattcacgtatcaaaaaatggtcgaaagttgaaggcttacattatctaaaagaaaatcaaaaagatggaattgttctcgtcggtgttcatttcttaacgctagaacttggcgctcgaatcattggtttgcatcatcctggcattggtgtttatcgtccaaatgataatcctttgcttgattggctacaaacgcaaggtcgtttacgctctaataaagatatgcttgatcgtaaagatttacgcggaatgatcaaagctttacgccacgaagaaaccatttggtatgcgcctgatcacgattacggcagaaaaaatgccgtttttgttcctttttttgcagtacctgacacttgcactactactggtagttattatttattgaaatcctcgcaaaacagcaaagtgattccatttgcgccattacgcaataaagatggttcaggctataccgtgagtatttcagcgcctgttgattttacggatttacaagatgaaacggcgattgctgcgcgaatgaatcaaatcgttgaaaaggaaatcatgaaggacataacgatatatatgtggctacatcgccgttttaaaacacgtccagatgaaaagacgcctagtttatacgattaaaagtgcggtcgaatatcaccgcactttttgatagaattttctcaaatttaaaaaattaacgaataacctcaccatgacaaccaattattcagctcaagaaattaccgttcttaaagatctcgaaccagtgcaaattcgcccgggaatgtacactgacactactcgccctaatcatttagcacaagaagttattgataacagtgtggatgaagcccttgccggttttgccacaaaaattgaagtaattttacaccctgatcaatccattgaagtcacagacaatggtcgcggtatgcctgtggatattcatcctacggaaggcgtttctggcgtagaagtgatcctgactaaactgcatgctggtggtaaattctccaataaaaattatgaatttgcgggaggtttacacggtgtggggatttctgtggtaaatgcgctttctgaacgcgtggatattcaagtcaaacgcaatggcgaaatctataaaattgcctttgaaaacggcagtaaagtagaagaattggaaattatcgggacttgtggtagacgcacaactggaacaatcgttcacttcaaaccaaatccaaaatattttgacagcgcaaaattttccgttagccgcctacgccatttattaagagcgaaagcagtcctctgttcagggcttgaaatcaaattcattgataaagtaaacaatactcaagacatttggttatatgaagatgggctttccgattaccttatcgaagcagtaaatggctttgaaacccttccgaaaaaaccatttgttggcgaatttaaaggagcaaatgaagcggttagctgggcattactttggttgccagaaggtggcgaactaatcggcgaaagctacgtaaacttaattccgactattcaaggcggaacgcatgttaatggcctacgccaaggtttattagatgctattcgtgaattttgcgaatttagaaatctattaccacgtggggtaaaacttaccgccgatgatatttgggatcgctgttcttacattctttcccttaaaatgcaggatgcgcaattcgcagggcaaacaaaggaacgcttatcatcacgccaaagtgcggtgtttgtcagcggtgttttaaaagatgcgttcagcctatggctaaatcaaaatgtacaagatgctgaaaaattggcagaaattgctattagttctgcacaacgccgattacgtgcagcaaaaaaagtcgtgcgaaaaaaactcgttagtggccctgcattaccaggaaaattagctgattgtggctcacaggatttagaaaaaacggaattatttttagtggagggcgactctgcgggcggttcagcaaaacaagcgcgtgatcgcgaatatcaagcgattttgccgttacgtgggaaaatcttaaacacatgggaagtttcccctgatcaagtattaggttcaaccgaaattcacgatatcgccgtggctctagggatcgatcctgacagcaatgatttatcacaacttcgctatggtaaagtctgtattctcgcggatgctgactccgatggtctgcatattgccaccctactctgtgccctgttcttacgtcattttccgaaattggtacaagacggtcacgtttacgtagcaatgccaccactttatcgcattgacttaaataaagaagtcttctacgcattagatgaaaatgaaaaagaggcgattttagatcggttgaaaaacaaaaaaggcaaaccgaatgttcaacgctttaaaggtttaggtgaaatgaacccatcgcaattgcgtgaaacaacaatggatcctaatacgcgccgtctcgttcaattaacttatgatttaggggaagatcaaggctcagatacattagaactgatggatatgttattagcgaaaaaacgttccgaagaccgtaaaaattggttacaagcgaaaggcgatcaggttgatttatctgtttagactaaattaatctcagcaaatccgaattttaataaattaagaatatatcaattaacagaaacaaaaatgacaaatatcaactatgaaggcattgagcaaatgcctctacgcaccttcactgaaaaggcttatctcaactattctatgtatgtcatcatggatcgtgcgttgccttttatcggtgatggtttaaaacccgttcaacgtcgtattgtatatgcgatgtctgaacttggcttaaatgccacggcaaaatacaaaaaatctgctcgtaccgtcggtgatgtactcggtaaattccatccacatggtgacagtgcttgttatgaagctatggtgttaatggcacaacccttctcttatcgttatccacttgtagatggtcaaggtaactggggggcaccagatgatccaaaatccttcgcagccatgcgttatacggaatctcgcctatctaaaatctctgaaatcttgttgaatgaactcggacaaggaacagtagattatcaaccaaactttgatggaaccttggctgaaccacaatatttacctgctcgtttaccgcatattttattgaacggcacaacaggtattgcggtggggatggccacagatattccaccacacaatattaacgaaattgctgatgcggcagtaatgttgctagataatcctaaagcgggattagatgatgtacttgaaattgttcaaggcccagattttccaacagaagcggaaattatttcgccaaaatcagaaattcgtaaaatttatgagcaaggtcgtggctcaataaaaatgcgtgcaacttggaaaaaagaagacggtgaaattattatttcagcgcttccacatcaatcttcgccatccaaagtcattgcacaaatagccgaacaaatgacggcaaaaaaactgccaatgctagaagatattcgagatgaagccgatcacgaaaatccaattcgcattgtgctagttcctcgctcaaatcgcgtcgatactgatgccttaatggcacatttatttgcgaccacagatcttgaaaaaagctaccgtgtaaatatgaatatgatcgggcttgatcataaaccagcggtaaaaggcttattagaaatcttaaatgaatggcttgacttccgtcgcacaacggtcactcgtcgccttcaatatcgcctagataaagtgctctctcgcttgcatattttagaaggcttgatgatagcctttttaaatattgatgaagttatcgaaattatacgccacgaagatgatccaaaagcagagcttatggcacgctttaatttaagcgatgaacaagccgatgccattttaaatttacgcttacgtcatttagcgaaattagaagaaaaccaactcaaagcagaacaagatgaacttgaaaaagagcggttaaatttagaagcaattttaggatcagaacgccgtttgaatacgcttatcaaaaaagaaattcaagaagatgcgaaaaaatatgccaatccacgtatgtctcaactggtcgaacgtgaagaagccaaaatgatctctgaaagtgatatgacaccagcagaaccagttactgtcatcttatcagaaatgggctgggtacgttgtgcaaaaggacacgatattgatcctaaatcattaagctacaaagctggtgatagctatctagctcacgcttgtggcaaaagtaatcaagccgttgtattcattgatagcacggggcggagttatgcactcgatccgctttccttgccttccgctcgctcccaaggcgaaccacttacaggtaaactcaatttacccactggtgcgaccattgaatatgttgtaatggccagcgaacagcaagaattattgatggcttctgatgcaggatatggttttatttgtaaatttgaagatttaattgcacgtaacaaggctggaaaagccttgatttctttaccagaaaatgccaaagtgttgaagcctaaaacattgataaattctaccgcacttgttgtcgcaatcacatcagcaggcagaatgttgatttttccagcacaggatttaccggtattatcaaaaggtaaaggcaataaaatgatcactattcccgcagcgaatgcaaaagatcgtagcgaactattgacaaaattattgcttatttcagatcaagcaagtcttgaattttattctggaaaacgaaaaattgtattaaaaccagaagatctgcaaaagttccgcgcagaacgaggcagaaaaggttcgacattaccacgtggattacataccaatcttgaaattatggtaatcgagccgtaacacaacacatcacttaaacataacatagggagatccaatttatgagctatacttttagcacgtatgaaacccttgcattagcaagcttagttttgctattgggctattttttggttaaacgcattaatgtattaaaaacatttaacattccagagccagttgttggtggctttattgttgccattggtcttttaatttggcacaaaattgatggaacatcctttaacttcgataaaaatctacaaaccacaatgatgttagtgttttttacttctatcggtttaagtgccaacttttcccgtctaattaaaggtggaaagccactcgttgtatttctattcattgctgcattattaatcttcggacaaaacgttattggcattgcaagttcaatggcattaggaatccatcccgcttatggcttacttgcaggttcagtaaccttaacaggtggtcacggcactggagctgcttgggcggatacatttgcacatcaatttaatctacaaggtgcaactgaaattgccattgcctgtgcaactttcggtttagtattcggtggtatcatcggtggtcctgtcgctcgtttcttattaaatcgccaaaaacaaggcgaaaatcctgaaaatgatgaagttgatgacattcaagaagcatttgaacacccaacttataaacgtaaaattactgcacgttcattaattgaaacaattgcaatgatttcagtatgtttattaattggtcaatatttagatgtacaaacaaaaggtactgcactccaattaccaactttcgtatggtgtttattcactggtgttattgtccgcaatattttaaccaacattttccgtttccaagtagcagaatccgctattgacgtattaggtagcgtaggcttatccatctttttagcaattgctttaatgtcattaagactttgggaacttgcaggtttagcaattgacgtattaattgttcttgctattcaagtagcatttatggctgcctttgcaattttcattacttatcgagcaatgggtaaagattacgatgccgtcgtattaagtgctggacactgtggttttggtttaggcgcaaccccaacagcaatcgcaaatatgcaagctgtcaccagccgttttgggccatcgcacaaagcatttttaatcgttccaatggtcggtgcattctttatcgacttaatcaacgctgcgctattaaaagtttcatttgcagttgtaaatatactcgcgtaaagtgcggttgaaattgacaatgttttagagaaatgcctttatcttgaattgataaaggcatttatttcaatataatcaattatttcagctgcaatatcaatcccacttgttttttcaatcatttctaagcctgggcttgcattcacttctaaaaccaataatcctttttttgaacgaattaaatccacgccagctacatctaaaccgatagcttttgttgcttgaatggctatctgcttttcttcatcgcttagggtaattttttcggtttttccgccacgatggcaattcgcccgaaactcaccattttgcccaattctctgcatcgttgctaccacttgatcacctatcacaaaacaacgaatatccgcattgcccgcttcttcgataaaatcttgctgtagcatagatatattggtttgcttaaaagcttccataatactcaccgcactttgtggcttttcagctaaaattaccccaattccttgtgaaccatttagcgtttttaaaattgtcggcgaactgatatgaggtatcgtcgcctgagcttgtacttcaccaccacttaaaagtgaattgggaacaggaataccagccttcagcaaaagttgcaaacttttccatttatcacgcgcatttaaaaatgcctgagatgaatttaaacaaaaagtccctttgccttcaaaatgctgtaagactgaacatcccatttgcgtactcgttgtgccaaatcgaggcaaaactgcatcataatcagacaataaataaggtttcgactctgaattttcttgataaaaaatctgaaagtgcggtggattttgcgagagttttaagaaacagtgattcggatctaaaatatccatctcatgcccttgatgtttagccgcttcttttaagcgttggcaactataaagacgaggttctcggcaaagcattaataatttcataacatttaatttattatctacgatgttccgtatattacacgaataaaaacgctttatgtagatgataaaaatcagtagaattacctagaatttttaactcaaaaaagggaaatcttatgttcgttgttatttttggtcgtcctggctgcccttactgtgtacgagcaaaaaaccttgctgaaaaattaaaaggcgaagttgctgattttgactatcgttatgtggatattcacgcagaaggcattactaaagaagatttatcaaaatctgttggtaaaccagtagaaaccgtaccacaaatctttattgatgaaaaaccaattggtggttgcactgattttgaagcattaatgaaagaacaatttggtatcgttgcttaatttttctttttaatttatacaaaaaagccactttcaatcgaaagtggcttttttcatagaagagttttaaccgttataacgtttaaaaattaatgtcgcatttgtaccaccaaaaccaaagctgtttgacatgacagtttgtaatcctgcattttctttcgtctcagtaacgatgttgcaaccttcagcggcttcatctaaggtttcgatattaatacttggtgcaataaaatcattatccaacattaataacgtgtaaattgcttcgtgtgcacccgccgcacctaaagagtgaccagtcattgatttagttgaagaaatcgctgggattttgtcaccaaatacatttttgattgcacctaattctttcacgtcacctactggtgtagatgtgccatgtacattaatgtaatcaattggggtatcgacagttgccattgcttgtttcatacaacgctctgcaccttcaccacttggtgcaaccatatcgtaaccatcagaagttgcgccataacctacaatttcagcgtaaatttttgcaccacgagcaagtgcatgttctaattcttccacaaccacaacagcaccaccacctgcaataacgaaaccgtcacgatttgcgtcataagcacgagatgctttttctggcgtttcattgtatttagttgaaacggcacccatcgcatcaaattcagttgcacattcccaagataattcttccgcaccacctgcaaaaaccacatcttgtttgcctaattgaattaactcaaccgcatgaccgatacaatgtgcagaggttgcacaagcagaactcattgaatagttcacaccacggattttataaggagtagctaaacaggcagaaacacttgatgccattgttttcgttactgcgtaaggaccaatcgcctttacacctctaggaccacgcaccgcatcacaagccactaactggttatgtgcagaacccgtacccgcaccaatcactaaaccagtacgatcattagaaacttgatcttctgttaagccagcatcctcaatcgcttcacgcatagaaagataagcataagccgctgcatcacccataaaacggaacactttacgatcaatgtgctcgcttgggtttaatttgattgttccggcaacatggctacgcatattcatttctacaaactcaggcacaacttcaatacctgatttccctgcttttaatgaagccaatacttcttctttgttgttaccgatacttgaaataatcccaaagcctgtaattacagttcttctcattgcttcttccttattgttttatatgtaaaaataacgactcaaaattactacgaaataaaaatatttcaagcaataattcatttgttcgaccagttcagaaaatcgcgttattatacgcaaatttcattaggcaagaaaggaataaaaaatgacctttagcgtccaacatgctgagattcacttcaaccaaaaccatattcccgtctcagatcaattcgatgatgtctatttttctaacgaaaatggattggcagaaaccgattatgtttttctacaaggtaatcaactttgggaacgttggataacacacaaagacgctaattttgtcatcgctgaaacaggatttggtacaggattaaatttctttgcggtaaccaaattgttccgtgaatttcgccagcaacacgagaatcatcctttaaaacgcctaaattttatttcctttgaaaaatatccgctaaaaatcaccgcacttttgcaagcgcatcttgcctgtccgcagtttgaagatttaagcgctcatttgcaacgttattggccttcattgattctaggttgtcatcgtattcattttggagagacaaccttagatttatggtttggtgatgtatcagaaaacttgccacaacttggcgattatatgaatgaacgtattaatgcttggtttttagatggctttgcgccgagttaaaaatcctgaaatgtggaatgatgatctctataacttaatgtttcgtttcacgaaacccaatggaacttttgccactttcaccgcagcaagtgcagtcagaaaaggacttgaatccgcaggctttaacgtgacaaaacgtaaaggcttcggcaaaaagcgagaatgtttaagtgggctaaaaatacaatcaaaatctaccgcactttcaacaccttggtatcttgctcagcctgcgaaaatggaaaaacaagatgtcgctattatcggcggtggtattgcctctctttgtgctgctatttccttaataaaacgtggggcaaaagtcaccatttattgtgaagatgacgcgctcgcacttaatgcttcgggcaataaacaaggcgcattttatccgcaacttagcgatgataatgcgcttaccgttgatttttacctgcacgctttcagttacggtcgccaattacttgattgggcaatcgaacaaaacatagtgtttgaacacgaattttgtggcgtggcactatgtgcttacaacgaaaaaagtgcggttaaattaacaaagatttctcagcttggtttaccgaacgaaatcttccaaatgctgagtgctgaacaactcagtgaaaaagtgggattaccgcttaattgcgaaggcggttggattgaacaaggggcttggcttgcaccaagacaatttgttcaaaatgccttttcatttcttgaaaagcagggtgtcgtcattaaaaccgcacaaaaaattaccgcactttctcagctagaaaaaggttgggaactaaaaaatatgcaaggtcaaaaatactgccatgaagtcgtcattcttgcgaacggacataaaattactgattttgttcaaacagaaaagctaccgctctaccctatccgcgggcaagtcagccaaattccaacatcagaaaacttactcaaactgaaatctgtgctttgttatgatggctatcttactccagccaatcaattaaaaacctcacattgcatcggcgcaagcatgttcgtgataatgttgatcgcgattttagcgaacaagaacaacaagaaaatcaacaaaaactccagcaaaatatcgcccaaccttggacgcaagatgtggatacatcagataatctcgctcgtgtaggcattcgttgctctgtaagagatcttgccccaatggtgggaaacgtgcctcattttgaacagcaacaagcggattattacaatctatttaacctccgccgccgtaaacaacctattcaaagtgcagccaattttcagaatcttttcttaatcgcagccttaggttctcgtgggcttacctctgctccactcttaggcgaaaccttagcttcaatcatttatggcgagccattaccaataagcgaaggcatattacataatctttcagctaaccgagcttgggtaaaaaagtggttgaaaggttcaaaagttgaataaactcataagattcagagccttacaaaaataactttaacgtgttaaaatcaaacaaaatttaaatataaaaatgaatacaaaaatgctatgcaatcaatcaatcaatcaatcaatcaatcaatcaatcaatcaatcaatcaatcaatcaatcaatcaatcaaattgtaggatttgttaaaacttgctacaagcctgaggaagtatttcattttcttcatcagcattccattcctttttcctccattggaggaatgaccaatcaaaatgttctacttaatatttctggagttaagtttgtattacggatccctaatgccgtaaatttatcacttataaatcgagaatatgaggcattcaataatgcacaggcatatcgtgctggcttgaatgtagaaactcccgtattagatgccaaaagtggcgtaaaactgactcgttatttagaaaatagtaatacgttaagccagatacaattaaacgaacaaagttgtttgtctcaagttgtgaataatttatatcgtttacacaatagtgaatttgtttttcgtaatgtatttagcgtattcgatgagtttcgccaatatttttcattgctagaaaacaaatccgctttttatcaagctgattcgagaatggataaactttcagctgtattttggcaatttgaagaaatcaataaagaggtaattttacgtccgtgccacaatgatttagtccctgaaaatatgttattacaagatgatcggctattttttatcgattgggaatattcgggcttaaatgatccgctatttgatatagctactatcattgaggaagctcatttatcgaaagaagctgctgattttctattagaaacctattgcaatcagacaaataaatatcacaagacagaatttcaaatcgctcacaaacggttaaaaatccatcgtttttgccaaaatgtattgtggtttttatggacaaaagtaaaagaagaacacggcgagaattttggcgattatgcgttaaaacgcttagacgcagcatttaaactgttagaggaattgccataatgcgtggctatctctttggcatactgtccgctgtattttgggcattatctggactgttgtataatgaattgccattaagtgaatatactgcgttagggaaagtgatttcattgctttttttaattgatttttgctcgttattagttatcggcatcacattatggcgaaaaagtgcggtagattttcaaggtgttttttggcaacctgcgttatctggcatattaggcggaccaataggaatgtctgcctatttattaagcattcattatttaacaatctattatgctgcaccgctttcatctctctttcctgttttcgctgcgttaatgtcttattggattctaaaagaaaaaattaccaaaacagcccaattcggattcgccttggctattatttcttcttcgttgcttgctattgaagtaggacaagaaataacctttaatactatcggttttatttttttaataatttgtatattagggtggtcatctgaaatagtgatatcctcctatacaatgcgttctctctctggacttcaggtgtattttttaagactatgtggttcaactattggttatttattgattctatttattctttccttgaaaaatttctcactagatatacttagttttaattatgtacaaattgctggtgtaataatctttggtgcattatcttactgctgctattaccaagcgatttatctgttaaaaccaatcaaagcaatggcattaaatatcacatattctgtatgggcaattggacttggttatctgctctataaacagccaattaagcccattaccttactgctcaccttattattaagtgcaggagtgatcgttacactttattacaaaggggaacaaaaatgaatgcaatcattttagcagcaggattaggcagccgatttaaagacatcacacaaagcacacataaatcattgttagatattcacggcacacctaacttagaacggacactcacttttctacgtcaagcaaatatcgacaatattgtcattgttacagggtatttacacgaacaattcgagtatctaaagaaaaaatatgactgcaccttgatttacaacgaaaaatatcgcgaatataacagcatttattccttttctctggcgcaagacttctttaatgattgttatgttattgatgcggatgtagtgcttaatcgtaatatttttctaacgaaaccatcacacagcaaatatttcacagttattcgttctaaaacgcacaatgaatggctaccgattttaaatagtaatggacaagtaatacgtattgatattggttcactgaatcaacccagtttgtcaggaatatcattctggactacacaggattgcaatatcattctaactttgctcaaagaatacacaagtgaagtgcggttaaaaaatccaaaactttattgggataccattccgatggaatatatagagaaattgaatatctatacggaacaacttaacagtgatgatatatttgaaatggataaccttgatgactatcaccacattttacaaaaattgacaccaaacaaggaaaaataatgaaaaaattgactctcagagaacaacaactcgtttgtctaaacatcttagattatttccacgcactgtgtgaacgatataaaattagctattctctcggtggtggaacattaatcggtgctatacgccacaaaggctttatcccttgggatgatgatattgatgtttatatgcaccgtgatgaatatcaaaggttcgttgatgtttggtttcaagaaactcacgaacactacaatatggaaacggcggaagatatccttgctcaatatactggtgaaatggcaaaaattttcgattgccgcactcaaataacagatgctaagggaagaaaaagcccaatgtttatggatatatttatctatgatggcgtaccgaatgaaccaaagatcatctatccactgatgaaaaagcatcgaagaattaaacttcgcttttcctcttgcaaaaaaagatggttaagggcaaaagaaaacaccgtgcaaaaagctatacttaataaattaagccactttctattttccaaaatgcaaaaaaatttagcacaattccaaataaaatatccgataaaacaatgcgattatattggtcttgtattatctgactacggtggttggcaaaaatcttatatgccgaaggaatattttaaccatgttatttataaagaatttgaaggacgacaatttcaagtaatgaatggatatcacgaacacttaacacaatattatggagattatatgaagcttccaccagaagaagaccaaaagccacatcatattcaagaagcgtatattttgtaagcgaaagggcagatttaattctgccctttttcaattattacttcacttttccacaattcaaacaatacaaatactgacctttaggatcattaaatttagttaatatattcaattctttttgtaatttttgaattggcgcaggcaaaccaagccatttaactaactgctcttgcgccccttttttagtatcgctcaataaggtgctaattaaactaacgttatcatctgtaaaccattccacgctaaaatcttgcacggcagtatcttggcgttgattcactaattgctctgctttattgaccgcttcattaaaagaacctatctcatccactaaaccattttggaatgcatcactgcccaaccaaacctgcccttgagccagtttatctacttgtgttttagaaagctggcgacctttgctgacaatttctaaaaatctgtcataaccgtgctcaatttctgtttgataaatatcttgcacgggttttgctaatggagaaaacgcagatgtattagctaattcagtggttgaaacaccatctgcatgcacgcctattttcttaatactattttcgaaagtcgggaacatcgtgaaaataccgatagaacccgtaattgtatttgaatcggcaataatataatctgcagtggatgaaatccaataaccacctgatgctgccattgcacccatagatacgatgacaggctttccaattttctgtaagttttcagtttcttgtcggataatttcagaagcaaaagcacttccgccaggtgaattaacgcgtagaatcacggctttcacagaattgtcatcgtgggctttacgaagaattcgtgcaatggtgtcgccaccagcattttcttcatcactttctccatcaataatcgttccttcaacattcacaaccgcaattttattcggtacgttgtaatgttctaaacgatcaggcagttgagtcaaataatcatcaaattcgataaggttcgcttttccatcacttcctttgccaaaaagtgcggatagttttttatctaaatccaaacgagttacaacatcagttactaatccacgttgttgtgcgtatgccgtactattgccttttaacgctttaagttctgcaagatactgtttcgcattcggcaaaatgcgatctttcttaatattacgattttcactgacggataaaacataattattccacatttcgcctaaccaacgttgcatatttgcttttgcctcagccgacatatcgttgcgtaaaaatggttcaactgctgatttataagtccctacgcggaaaatatgtggtgtaacggctaatttgtcaagcatctctttaaaatacaaattctcttgcgataaaccgtgaatatccacgcttccaattgaatttaaataaatttcatcagcaaagctcgctaaataatattgtccttgtgaataattatctgcataggcgatcactggtttccctgcatctttaaagtgactgatagcaccaccaataaaatctaatgcgggcaaatctgccccttcaaaataattaagatctaacactaatcctttaattttaggatcatcttccgcttgttgaatggcaaataccacatcaaaagtcgaaatttttctagggacgtgctcgccattcaattcgcttaacgcatcttgccaacgaagtgtttcatctcggttgtccgctaaataaccatctaaattgagcaataatgcgccttcgctcgttaatgcagtagattttttcccgccacttgaaaagctaataatcgccactagcaatagtacaaagcctaaaaacacgacattcatcacaagatcacgaatgaaacacagcactttccaacaaaattttaatacttgaaacatacaaattacctttaaaaaatttgtgctagcgtatcacaaagccttgtcaaaaactatgctataatccaccgcacttttacttataagggataataaaatggatgcacttacacttttaaccacaagaaaatcaaacaaaaaattgaccgcacctgcacctaatgcagaacagcttgagcgtattttcgaagcagcaatgcgtgcaccagatcacggaaaattacatccttatcattttattgtaatggaaaatgagagcttaaataaattagaaacgctacttaaagctgccgttgtagaatttgatcttggggaagaaaaattgatgaaagccgaaaacctagcacatcgcgcacctatggttattggcgtggtagcaaaaatcgatccaactatcgctaaagtgcctggttgggaacaaatgttgagtgcaggttgtgcaacttatggattacaactggctgcacaagcacaaggatttgataatgtgtggatttcagggaaatgggttaatggcactgcattacgagaagcgttcggatgtcgtgaacaagatcgtgtgattgcgttagtcatgattggcacgggcatggagaaagcagaacgtgaatgccgagttatcgatacaaaagattttgtaacctatctataaaatattgcttgctttcctcaatacttagagaaaagcaaaatattgctctactcttcttccaattcatccgccattgtcgccaatatttctcgtgtaagaagggccaatgcacgataaaaaggcaaagttgcttgattttctacttgagttaaaaacttcgctgcacaaggcagtaaaaaagtttcaaagaattcttgttgagccactaaagaatccgaattatcttcaagccaagaggctgtgagcaataataaagcaaaatgatccgcactttccacctctggcatattgcgtacaaggcgaaaattcacaaattcttcaacatcaatgccataagctgaaatagccgtcatcactttaccattggtagcaaataatttttgatactcttcgttcaataaattgagatcgattttaacttgcaagctattcagcgctaattcactttctttatcagtatctaacgcccaaacttggctcaaaccttcttgttgtaaccaaacaaatgcgtcagcgagtactttatctgttggaaaacgataaaaaagattaccgaataatcgactaattaatgaaaaattattaatttgtttttcagacattactctttttcctttaaaagtgcggtcaattttgcttgagttttttgagcagcaagttcaatcatcgctttacgcgccttatcatcaattaaatgaatatctccaaataattcaaactcgacattttcaattccacaataattgaataatccattaatcaaacaatgattaagcgatttatctacaccaaattctttatatttatcaacattactgccaatcgtaataaattgctgcatttgcttatttttgagcaaccccactgattcgccgttttccgttttataagcaaagccatggcttaatacgcgatctaaatagcctttcaaaattgctgggaaccccatccaccaaaggggataaaccaacgtaattaaatctgcttgaagaataaaatcatgctcttgctgaatatcttctggaataataccattgttagcattctgcaattcttcatgagataaaattggattaaaattcatttcataaagatctcgaaaaaatacatttacaccattttcttgactaatttgctcaatacgattggcaatcgctcgcccaaaactacgcactgaattaggatgagcaaaaataattaagtgattcatttttcttacctatttgtagggaaataaaacgtgacagaagtctatcaaaatagagcgcactttgcatataaaatcacataaaaaaagcgggcatatcccgctctcttatttgcatcatcattatgctgcgtttttacgttcttcttccatacatactgccgcagtaaataatacgtcagttgatgagtttaatgctgtttcggttgaatcttgtaagataccaataatgaaaccaacaccgatcatttgtgctgctacatcatcagaaataccaaataagctacatgctaatgggattaataataatgaaccgcccgctacgccagatgcaccacaagcacaaagtgctgcaacaatacttaataaaagcgcactaacgaaagaaacttctaagcctagtgtatgaactgcggctaaagttaagatagtaatagtaatcgccgcacccgccatattaatgttcgcacccaatggaatagaaacagaataagtttcttcatcaagatttaagcgttttgctaattcaatgttcactggaatatttgctgcagaactacgtgtgaagaatgcagttaccccactttcgcgtacacaagtccacactaatgggtaaggattacgacggattttccagtaaaccaaaataggatttacaacaaaagcagtaaataacatcgtaccaattaatacagcaagtaattgcacataaccgcctaatgcgactaaacctttatcagacaaggtttcagccactaaaccgaatacaccaaatggcgcaaaagaaataatcacgtgaacaatttttgatacaccttctgcaaaatcagataatacgttcttagttgcatcagatgcatgacgtaaagccaaacctaaaccaatagaccatgctaatacaccaataaagtttgctttgaaaattgcatttaatggatcatctaccacatttaaaattaatgttagcaacacttgaccaacggcttgtggtgctgaacttgaatcttctttcgcagccaataccacttccgttgggaatgcgaaaccagcaataacagcaacaaatgcagctaagaatgtgcctaaaaggtaaagcacaattatttctttcatattgcttttcgtaccaattttacggtttgcaagggcagccataacaagaaagaaaattaaaattggtgcaacggcacgcagagcttttacaaaaatcgtacctaatacgccaactttttcagcaagattaaaaccaatggtttcttgtaatggtgctgaaatcaatgcaacaacaataccaagaaccaagccagcggcaattcgttttaccaaaccaccctgaaataacagactaaatagacgtgatgtgttcatatttttatctttcttttagtaaatttaacttcagattgttaccaatccacctagggggaattaaagatagcgtaaaattttaatgaaagaaaatatttttattatttttcactctaaaagtgaacttttttctaaagttattagatattctctaaaaacatacttataaaaaaattttttatttaacctattgacaccctgtatgaaatatcagtaaaatttaactgtacaaaaaaacaaggtaaaaggttatttatccatattatttaacaggagataagagaatgaacaaccaaactttggctacacaatatgaaatggatttttcttataatccactgccttttttcagtgatatagaagataaccttaaattcaacaaaaaattagatttaaatctttactgtatcaaacgtccaaaacaaacttgttttattcatataactaacccaaatatgttggcttggggaattgaaagcggcgatatgttagtcgtcgaaaaaaatgacgatctttattctggtgatcttgttgtgctagaagaaaataatgaatttcatgtctatgaatttatggcgcatagcggcaattatcttttcatggcattggattccacaacacaaaatataaatacaaaaagattggtcaaatttacctattatcggcaccgtgaccaatacgattcatcaaatgaaacgtcgcgataaaatgaaatgggcagcgtagttaaaagcaaataaaaaagtgcggtgaaaatcaaccgcacttctatctagtatctagattatatttcaattaattactcgtcgctttacgtctagcaataactgcatcagaaagttgttgcaataatctttcagaatcttcccatccaatgcacgcatccgtaatactttgtccataagtctgtgctttgccatcaactaaatcttgacgaccttccactaaatggctttccaccattacgccaaagatttgtttagaaccaaatgcaatctgattacatacgtcttggcaaacatccatttgctttttatattgtttactgctgtttgcatggctaaaatcaaccataacgtgtggaatacgccctgttttttcaatatcagcacaaactttttctacatcttcagcactatagttagggcctttatctccacctcgtaaaataatatggcaatcttcattcccttttgtagaaacaattgcagaatgaccaaatttagtgacagataagaaatagtgaggagcttccgctgcaccaattgcatctaaagcgactttcacaccaccattagtggcatttttaaacccaacagcacaagataaacctgaagccaactcacgatgaacttgtgattctgttgttctagccccaatcgccccccagctcataaaatctgccaaatactgaggtgtaatcatatctaaaaactcgcccgctgcaggcacaccaagatcattaatatctgaaagtaatttccgtgcaatacgtaacccatcatttaaacgataagtatcattcaaatatggttcattaattaaacctttccaacccaccgttgtacgcggtttctcaaaatacacacgcataataatttcaaggctatctttgtatttttcacgtaatggttttaaacgagtcgcatattcaatggctgctttcggatcatgaatagagcaaggcccaatcacgactaataaacgatcatctttaccatgaataatattatgtgcctcatgacgagtttgcttcactaacgccgcagcctgttcacttgctgggtatttttctaataaggcaatgggtggtaacacctgatcgactttttcaattcgcgtatcgtcgtttgccacgacaatttcaattttctctttagccatacattactctcttgctttcaaatgttgtgtttaaattatgtagctaatctacacttatttttgtactagtaaactagttcgatatgtttttttagaataaaacctacaaattccctattaaactatctttacaactctcttgcaagctgaataaaacgaaataattaagtaaataaaagataaaaaaataccgcacttttgtgctgtactctcgaaattaatggctacttaatacttgtgcaggttgtaatttagcagctcggcttgctggataaaggcttgccattaaactcaatgcaagtgctgcaactaaaaccatcaaaacatccaaccaatgcaactcgcttggcaagaaatccacaaaatacacatcgcccgataataatttcttaccgataacccactcaataccttgaataaaggttgtaagatttaatgcaagtataatgcctaacacaattccaattaagcaacctttcattcctgcctgtaagccataccaaataaaaatacgtttgataaacgcattattcgccccaagcgtgcgcataatggcaatatcgccttgcttatcttttactgccataatcagcgtagaaacaatattaaaacacgcaacaccgatcacaagcaccattgcgatatacattacggttctaataagctgaatatcgcgatacatataaccaaatttactaatccaattttgcatatatagcatctgcggataatcattaagcattgataaatccagatttctcgcagaaaaaggatcatctaatttcaattcaacacctgtaatttgatcaggttgataagtcaaaaaggtttgtgcttgagcaagcggcaataaggcataactataatcaagctgaccatctaagcgtaaaatagaggtaacttgcactggctcacgagttggttgagcaaattgttcatcgccgttttgctgagaaataagcaaggtaatccaatcccctacttttacatcaagttctttagcgatacccgatcccaagaccaatccgccttctttctcaaatttgttccaaccttgctcttgtacaaaattgccaattgaacttaccttatcttctgcttgtttttcaacacctttgacctgaacaactttcaattttgagccattttctaccaatgccgtaaagctaacaaaaggagagattcctttaatttgtggattttgttgtaggcgtttttctaaattttgccaatggtgaatggttggttccgtcgcattgggtgcagataaaatctctgcatggggaaccactgcaagaattcgttgattaagctcacgctcaaaaccattcatcgcacttaaaccaacaattaaaactgcaacacccaatgcaataccaattgcagaaaattttgcaattaacgcgactaaaggatttttttgtttgccacgttgataacgccagctaataaaaaaaggcgtattcattatgcaccttccttcaaaagaccatcttgcatcactaaacggcgtgataatttttccgcaagccccatatcgtgagtgactaataaaaaagcaatattttgctcttgattaagttgttgaatcagctcaaaaatactttcagtggtcttgtgatcgagatttcctgtgggttcatccgctaaaactaacgatggattattcactaaagcacgcgcaatcgccacacgctgacgttccccaccagaaagcgcagaaggacgatgggtaattctatgacttaatcccaccgcacttagcattttttcggcgcgatctttcgcttcagttttattttgatgaccaatcaacatcggcatcatcacattttcaagtgcggtaaaatccgccattaaatgatgaaattggtacacaaatcctaaataacgattacgcaaagcagctaattcattagccgatgctttttgcaaggattgtccattaataaacacttccccactacttggctgatctaagccacccaaagtatgtaataaagtacttttccctgaaccagagcttcccacaatcgcaaccaattctgcaggttccatagaaaaagaaacgccttttaacacttgcgtttgattttcgccttcttgataaaatttattgatattttcgcattttaataaatagttattcattttttactcgttttaaccgcactttagcggcagataacaccatcaaaaacttgcacgagtctatcacacttttccttgagcttaaatttcaatacacctaaagtattcaaatcctgtttcaggaaaatgtttttcaagataacgttttaaatagcgttgggtttcttgactaataataggtcatattctgggtaaccgttatacattacacttaatactgaaatacctcgagtacgacaagcctctaaacttaataatgtgtggtttatactgcctagttttcccgatgtcactaaaattaaagggtaattatttaactggatataatccaacgtcgtcgcctcttcacaataaggtaccattaagccaccagcaccctccaatagtacataatcatatttttctgccaaaagtgcggtagatttttcaatgatttttgcttcaatttttctactttctcgctttgcagctaaatgtggcgaacaaggatattcaaaaacataagggcaggttttgccttgtaaatcttcttccgttaaatcaatcccttgaatctttcgatgtacaagcaaatcatcagcaatatttttacagcctgtttgaatcattttttgtgtaatcacggaacagccttgttccatcaactttttagcataaatgcctgttgcaatcgtttttcccacatcagtatcaatgccagatataaaaataacctttcccataaatattccttactgattttctatgtgagaatagcgtgcgataaaaaataacggatgataagtcaggcgcactttgcccgacggcataccaaacgccgacaagtaatcgccaataaatccattgagattttttcttgtccaatttttttggttcgtggctgttacgcctgtatatttaaggtgtttgagtacatctaacggcgtatcaaagtctagtattaccttaaaatcctcacaccataaaagctcaaaatctttggctaaccaagtctgccattgggataaagtcgggtaatttaagcctatatttgtgatctggcggacttcttttaaattgtcttcgccaaaggttgcaaccgccaataatccgtttgttttcaagcctgttttgcaatgggcgataaaagcgtcgggttggtgaaaccattgcacggcggatgcgcttgcgattaagtcaaattgttgcaaaaaaaggaaatgttcggcatcgccgcaataaaaatcaaaggattgcggcaatttttcagccagttgggtctgcacatcgcacaaatcattaaataaccaataatccgctgaaatctgtttttgcaacaatgaactcaacataccagacccgcaaccaagctccaaaacactatctagtgacccatttggtaaatagtcttgcaaatgcgccattaaattaatcgtcattttctgttggattaaggcgtgcctgtcataatcgtttaatgctttttggaaagcctgccgaatgcgcgatttatctacggaagttaatgatcccataatgccgaccagtgggtaaatcttgaaaacacataatgctcaccctctatttcctgaactgcacaacgcaatgcccaatattggtgctgattagctggcgtaaaaattttatcgcgagaactaacccatgcatttgcccagtgaataagatctatgcgtttatcctgctgaatcatcgcaaaaagtgcggtaagttcttgatgaatttcgtcaaacggacgggctggaaataattggtaacgttcaaaagatgctttatcgccacagattctgcgttcaaattttaaacgggtattttctgtgagattctctagcgtacctttaaaaatagcgtagggaataccgaagctatcatcacaaggtaaacctgtgccattcactgccgttgcggattttaatcttattccttgtaatactcgctctgccacccaaacgcccatagaccacgccaccaaacggatgtgccgataggcggaaagatcaaaatccaaatttaaatcttgataatcatagcaaatcaataaatcgtgattttccggcaaaatcaaatgatttacagcatcgggcggcgttccccaacctgcaaaatacaggattaaatgttcgccttggtaatcgtaaaatttcgttttcatatcatatatttataaatgcaccgcaaactgccgcacttcatctgccgtcatatcggcagttagagacaggcggattctggatgtgtttttgggtactgtcggcggtctgattggcaaacaataataaccttgctcttgcagatctttcgccttagcaagggttgcttcgttctcgcctaaaatatagggaacgatgcaagtttggcttggcattatttgcgttctgtgttccacttcttggcgtaaaaatgcacttaactgctcaagatgcgttctttcttttgaaagttgtggtaatcgttcaaaaataaaatgagtccacgccacattaaagggcggaagtgcggttgaaaaaatcaatggacgcatttgattaatcaaacattcttttaatatttgatcacagacgacataagcccccattgaagctaaggccttgccaaaagtgccaaccaacaaatctatatcagctatcacattagctcgttcggcaatacccaatccgttttgcccataaacaccgacggcgtgggcttcatccacataaagataagtattgggaaattgtttttttaattgaacaagctgtttcaaatccgccacgtcgccgtccatactgaaaacagattcggtaacgataaaagtgcggtcaaattttccgacgtttttttcaagcagatttttcaaatgttcataatcattatgacgataacgaaagaactcacattggcttaaacgaatgccatcaatcatgctggcatgcactaatttatctgccaaaatcaaacttttcgtcgtcgtcaaagcaggcaaaatgccgatattggcgtgatagccgctgttaaataataacgcactttcccgttggaaacgttgtgcgacaagctcttccaaatcggtataaataggaaagttgcccgttaataaacgcgatgaagaactggtaaaagagggaaaattaccgccatattgctgtaaaaaagactggcgcaagttttcatttgatgccaaacctaaataatcattagatgacatattcagcattttgcgattttctcgcgtaatatatcgtccttgatgaactaaatctggaattgaacgatattgattttttgcgctaagctgttccagttgctgtttgaaagcatccattttttatcctaatgttcatattcctgagttaaagccagaatcatgccttccgttaatttctgaagttcatcatctttaatcacaaatggtggcataacataaaccaattttccgaaaggccgaatccaaacaccttgttccacaaaacgtgggactaaagttttcatatttaccgcacttttcatttcaaccaccccaatcgcccctaatgcacgaacttctttgacgtaatctttttcagataaaggcgaaagctgttgttttaaggaagactcaattcgctgaatattttgctgccaagggctttccaacaataaacggatagattctgctgcaatcgcacaagccaacggatttgccataaaagtgggcccgtgcataaagcatttagcctcaccgctacaaatagtttgcgcaatttcagtggtcgtaatgcttgcagataaagtcaaatacccacctgttaaggctttaccgatacacataatatctggcgaaatgcctgcgtgttcagctgcaaataattttcctgttcgaccaaatcccgtggcaatttcatcaaaaattagcaatataccatattgtttacaaagcgcttgcgctttcactaaataagttggcgaataaaaatacataccgcccgcaccttgcacaaccggttctaaaatcagtgcggcgatttcattaccttttttcttaagtaaatcagctaaaggttcaatggcacaatcattccaagattcattaaatggaatgttgggttgaggaagaaaatactgcacgggtaagctatgatgaaataaatgatgcatccctgtggttggatcacacactgacattgcattccaagtatcgccgtgataaccagaacgaatagtggcaaatttttgtcgttgcacttctcctttagcgtgctgatattgaatagccattttcatcgctacttccactgcaacagaaccactatcagcaaaaaagatcttatctaatccattgggcaaaatttgtaccaataattgagctaattccaccgctgggtcatgggtaaatccgccaaacataatatggctcatttttgctaattgattctgtgccgccgcatttaaacgaggatgattataaccgtgcaacgccgcccaccaagaggacataccatcaatcaaacgacgaccatcttttaaagttatcatcacgccatcagcacgttccaccgcataaagcggcatatcagaagaaactgaagaataaggatgccaaatatgttgtgtatcaaaagctaaaagtgattgttcatccaccatttatttaccattaaaaacttattcgtatctcaaagctgctgcaggttctactttcgcagctcgataagcaggataaagggttgaaagcaaggaaagtaacagcgaaaatccaatgacaaaaatcatttgaacaaaggataattctgtcggtaaaaaaacaccttgtggatttaccgcacttacaatgtccgttaaattcaacgtagctaaaacacctaaaatagcaccgagtaatgtgccaacaaatcccaccagtaatccttgataaatgaacactgaacgcacttgggattttgttaagccttgagtttgcaaaatcgcaatttccccttgtttatccaccaccatcaaacttaaagaggtgacaatattggaaatcgccacgacaataatcaaactaatcagcaaacccatcatatttttttccattctcactgcttggaaaaattcgcctttttgcacacgccaatctgtgattttttgtgtcgggaaatgttgtgggagttctgtaatttggaacggatcattcagaaataaacgatagccctgtgcttgctgaggttgaatacgcattaagcgaccaatatctgtaatattagcaaaggcttcgtaaccagatgcttcgccataaccataataaatatcgctaacagtaaataaacgctgcattggcacccgaccgaatggtgtatattggctattttccgtaatcatcaaacggattttatccccaatattcacgcccagtttttgcgccagttgatcgccaatgaccagtttaaactcccctctaggcaaaatttcattaaatttagtctgatcaaaagattcaaccaaaggatcatcagaaaatgattgaatacctataatttgtcctgcacttacgccttttgccgtttgataaatcacatttgttgtattgatcggcacggctttttggacaaagtgcggtaaattttctagcgttttttctgtagaaataggctgctcttcgctcacaatcgcatgaggaatagaagatagcacctgttgtttttggtaaccttctaatccattcatcaccgaaagcacgatgatcaatgccatcacacctagcacaatccccaggcttgcaagattagtcactaatcgcccaaaacgatccgcacttttcgcacgccaataacgtagtgcaatataaagagaaataggaaaattcattatttttgatgtaattgttgtacaaattcttcgatgttttgcattactttgccaactaatgttgtcactgcactatcactcgcccaagcaatatgtggtgtgataattaaattaggcatcgtttttgcagctaaaattaacggattatctttttctggtggctcttttaccattacatccaaagccgctccgcctaaatgccccgtttttaacgcatcaactaaggcaagttcatcaatcaaaggcccacgccctgtattaatcaaaaatgcaccttttttcattttggataaggtttctgcattaattaaatcctttgttgtttccgttaatgggcaatgcaacgtcacaatatccgcttgttttaatacttcatcaaaaggcgtataaccttcacggcaaacagtggcatctttatgttctgcataaagcactttcattcccacggcattagccaaacgccccacttctgttcctaggcaacctttaccaaatacgcccaacgttgaaccgcgcacatctgtaattggataatcaaaataacaaaattgtttactttccgcccattttgcttccgtttgatcgcgtaaccaacctgccaaactgtgttttaaagaaaaaatcagaccgattacgtgttctggcacggttgtactggaataacctgtcacattacgcacggcgatgcccatttcttctgcagccacaagatcaacattatttgtacctgtcgcagtaatggcaatcagctttaattttggcagttgttgcaaagtttcacgatcaaaaatcactttgctcgtaatcacaatatctgcatcctttacgcgttcaatcgtttgctcagcagatgtatgttcatattctgtccaagtatgttcaaaacttgggcgaggaattgaaatatgtttaggaatagccgtgctatctaaaaatacgattttcattaattgctccttttttatatacaaagtgcggtcaaaattaaccgcacttttgatgaaatttaaattgaggtatccaattctggaaaagattttactaaatcatcgatggctttcatttgggaaacaaagccttcaagcgcagaaagtggcaatgcagaagggccatcacattttgcttgatttggatttggatgtgcttctaagaataaacctgcaatgcctactgctaaacctgaacgcgctaattcggttacttgtgcacgacgaccactcgatgctgccccaaatggatcacggcattgaagtgaatgggttacatcaaaaataacagggctacccttagaggcttttttcattacactaaagccaagcatatccacaattaaattatcgtaaccaaaatttgttccacgatcacaaagaatgattttatcgttaccacattcttcgattttttccacaatattacccatttgacttgggcttaaaaattgtggttttttcacattaatcactgcgcctgtttttgccatcgcttcaacgagatctgtttgacgcgccaaaaaggcgggaagttgaataatatcgacaacatcagcaacgggctgacattgatagatttcgtgtacatcggtaataatttttaccccgaatgtatcttttaattcttggaaaatttttaatccttcttccatgccaggtccacggtaagaatgaatagatgaacgattcgctttgtcaaaagacgctttaaatacataaggcacgccaagtttctctgtcactttcacataagcttcgcacacttgcattgccatatcacggctttccagcacgttcattccgccaaaaagcacaaaaggtttgtcgtttgcaacatcaatattgccaatttttacaattttattttgcataaattttccttaaatcaatggaggggaaaagtatctttattaatctcgcctttaagttctaaaagttgcgtgcggataaacgccgccgttggatcttttggacaatgttccacaaaaaattctaaatctttcaatgctgaaggataagcccccatttgagctaaaactaagccacggtcacggatatgataaggattttcagcatcagtaatcattaaattcttaatatagtgatatgccatatcgttatgctcttcacgaataagcgcatttttcgccagttgctcaaagcgagaataaagtaaagaaagatcggctctatcaagttcttcgggttgaattttcgccccaaacccaaatgcaccttcataaagttgctgcaatttttcttgtgaaatataagtgccatcccaaggatcaataaaagccacttcatctctgacttcagcacgtaaaattaactgtgttgggaaatttactgggtaaattggcaaatccaatgcctcagctaaataaaacaccattgccccaagagtcactggcattccttgacgatgttcaaacacataaggcaaatataaattgcgagcataaaaataatcttctggatcgcaatgaaagccccaatcaccataaaatagctgtagtaactgatgaatctgctcttctttcggccaatctggcgaaatttttttacgcgctttacgcacaagcccacccatttttccccgaagttgtgcttctgagctgccatcatcagagataacaagataaaaatgcacaaatttatcgtataacgcacgtcgataatatttcattacttcttccaaaaacctaaagtgacacgctcattgtcgctataatcacgcacagtttcaaccatttcccaatgattttcttggaaaattgaccgcactttttctccttgttgccatccgtgttcaagcaataatacgccattagaattcaaataactcgatgctaattcaataatatgacgtaaatcagcatacccctcatcattggcaactaatgcagaaaggggttcaaaacgcacatcgccttgatgcaaatgttcatcttgcgcatcaatataaggcggattgctgacgataagatcaaacttccctgttatattatcaaaccaacggctttgcaaaaattctacatttagctgatttctttctgcattagattgagctaatgccacaacatcggacataagatccacaccaattatttccagcggaatatgccgcttttggcaaatgggcgcaagctcggaagccaaagcgagggcgattgcgcctgtgccagtgccgagatcaagaatacgaaagtgcggtggattttcttccagtttttctaacgcaatttgtaatgccttttccactaaaatttcagtatctggtcttggaatcaatgtgccttttgagacatttaatggcaacgaccaaaattctttttcaccaagaatataagcgataggttcaccttttagacgacgatctaaaagtgcggtcaattttaaccgcactttttcatcaatctcagtatcatcaaaagcaaggatttgcgtacgcgatttgccagtagcgtgttgaagaagcacaagtgcatcaattttactattttcagtgggatttttttttgctaaatccgcaatcgcttgtgccagccattctttataattcattatttttcgtcttttaacactatcgtgccagccactaaatcagttaaagaacggcgatcatcgcgtacaagtgcaacaataccgctaataatcaataagaaacttgtccacgccaataaaatatcaataatctcacggccgatgtatttaccaaattcaacaggctgattggtatgataattaaatacgcgcaagcctaaccagcgttttgccattgtttgaccataagttttcatgaaatataactgaaaaccagcatatacaatcatccccactacaccggcaaaatcccccaatgcaaaaccgagaccagccatcacccaaagcacaagcccattaatcatacttgcaagccaacgtttaaaacggctcgcttgagcgagttgagaaggcttgaaagcagaagaaaattcagcatctttttgattttcaatgatcattttatttccttttaaagttaaaaaggacatctgaaatcagatgtccctatcattaattctgttcagacaatgcagccaactgatccgcttgatattcggtaataatcggctgaatcagttcatcaattttaccattcatcacttcatccaaacggtaaatggtgagattgatacggtgatctgtaactcgaccttgcggataattatatgtacgaattttatcagaacgatcgcccgaacctaataagttacgacgcatatctgtttgttctgcggcttggcgttcttgctctgcttgaacaatacgtgacgctaatactgacattgctttcgctttatttttgtgctgtgaacgctcatcctgacattccaccacaatacctgttggaatatgtgtaatacgcaccgcagaatccgttgtatttacgtgctgaccaccagcgcctgatgaacgataagtatcaatacgcaaatctgctggattaatttctggcatttcagattcaggcaattctggcattaccgcaacggtacaagcagacgtgtggatacgcccttggctttcagtttttggtacacgttgcacacgatgaccaccagactcaaacttcaactgaccatacacaccttcgccagtgactttaacaatcacctctttataaccgccttgctcactttcgttagcacttagcatttctacacgccagcgtttactttcagcataacgactgtacatacggaataaatcacccgcaaaaatacccgcttcatcaccgcctgttcccgctcggatttctaaatagcagttatattcatcattaggatctttcggcagtaaaagaatttgaagttgttgttccacttcttcaatttccgctttggattcttcgatttccatttgtgccatttctttcatttcaggatcgtcgagcaatatttcagcttcttcaatattttgatttaattgcgtccaacgattaaaacatttcaccacttcttcaagttgcgaatattctttagaatacgcacggaatttatcctgatcactaattacagaaacatcgcccaataaggcttctagctcttcatagcgttcttttaaactttctaattttgcaataatggaatctttcatcatttgtaagtcaccgaaaataaaatcggcgtattctagccgattttagggaaaattgacagcgaaaaggaaattaagaatctcagacgctttatttgtgatttacccactatttattggtgtcttgtttttgattgagctcacgatatttatcacacccttcttgactgcgtaaatcgcaagcatcgccaaaatattttttggctttggatttatctttttccaactcgcctagcttaattaacactttcggatctttacttaacaccaattcttctttaattgcttcaattttttcttgaagatcaggctgttttggcaaatcaaaaacacactaaaacaaggcgacaatatgcttgctaatcctagttgccaattatgctttgttgtactctctgtaaagagagtacaacacccagtatactgggtgtgaaatgattaaaaattgaactatttaattaggagggaattggagggcttaagactgaaaaaagtgagcaattttgatcactttctgccattaaatacacgtgacatcaaacttcgccaaattaatgtcatcttctgtgctataaaatgccactaacgccttgcgtaatgtttcagctcgttttggtaaacctttttccgcgtagattttcacttgttcatacacggcttgtttaaaaggctgtgtatcgcctggattgccattcaaattatccgcactggcaaaataacgaaaacctgccgccgtcgccaaaatccactctaatgcttgcggtttaacttcaactttttcaaagtcacgctggcgttcttctgaacgtccatctggctcataccaataaccaaaatcttctagtttacggcgttctttgcctgccactaaccaatgggcaatttcatgcaatgcactgctgtaaaagcctcgtgcaaaataaatcgcgttataaggcacttcatcatttgcgggtaaataaataggctcatcaccgcctttgactaagcgagtgttgtattcctcttcaaaacattgattaaaaattgcaataatatcttctaatttatgttccatggtatcgactcctaaaaaaccgcaagattatatcaccataggctcatttgttcttgtttattttcttcaggtaaattgacatgtaacccaatcaaacgaatcgatcgcccttttgctcgcataaaaatttgaggaagtaattgctgaaaactctccaaagaaagtggcaaacctgttttctccaaagtagttacttgaaaatcttcaaatttaagctttacgtataagttcgcgaatctttttgcataaaatcatcataatgattgctcctaaaataaaaagaagtacgcatagaatgatgcgtacttaacgtagggtgggctttagcccaccaaaatatctcacgattgtttgttggtgggctgaagcccaccctacaactactaaagcccaccaaaatatctctcgattgttttttggtgggctaaagcccaccctacaactactaatcaacaatcaacggctcgcattataggaaacaagcaggtttaaatacagaaaataataagaatagtttttatttcttgatttttatcaaaaatcaatctttattgttgtgagaaaatacctttcttcatataatatgtttgagaattattattattttttttataggactaaatatgaccaattttagattaaacgtgcttgcctattccgttatgcttgggctaacggcaagtgttgcttatgctgagccaaccaaccaaccaaccaaccaaccaaccaaccaaccaaccaaccaaccaaccaaccaaccaaccaaccaaccaaaatagtaatgcttctgaacaactagaacaaataaatgttttgggttcagataacaacaatgacaacaccccacctaaaattgccgagactgtaaaaacggcgagtcaattgaaacgccagcaagtacaggatagtcgtgatcttgtgcgctatgaaaccggtgtgactgtggtagaagctggacgttttggttcgagcggttatgccattcgtggtgtggatgagaaccgagtggcaattacagtagatggcttacatcaagcagaaaccctttcttctcaaggctttaaagaattattcgaaggttacggcaattttaacaataccagaaatagtgtggaaattgaaacgttgaaagtcgctaaaattgcgaaaggcgctgattctgtaaaagtgggtagtggttctttgggaggcgctgtactttttgaaacaaaagatgcccgagatttcctgactgaaaaagattggcatatcggctataaagcgggctactcaacggcagataatcagggattaaatgctgtaactcttgcaggtcgctaccaaatgtttgatgcattgattatgcattctaagcgacatggacatgaattagaaaattatgactataaaaatggcagagatattcaagggaaagaaagagagaaagcggatccttatacgattacgaaagaaagtacattagtgaaattctctttttcgccaacagaaaatccatcgttttacagtcgcctctgatacttatcttcagcattcccgcggacatgatttttcatataatcttgttaaaacaacatatattaataaagatgaggaagaacttcgtcatacaaatgatttgacaaaacgtaaaaatgtttcctttacttatgaaaattatactgttacgccattttgggatacgctcaagttaagctattcacaacaaagaattacaacaagagcaagaacagaagattactgtgatggtaatgaaaaatgtgactcttataagaatcctttagggcttcaattaaaagagggaaaagtcgttgatcggaatggtgatcctgttgagttgaagcttgttgaggatgaacaaggtcagaaacgacatcaagttgttgataaatataataatccttttagtgtagcctctggaactaataatgatgctttcgtaggtaaacaattatctccttctgagttttggttagattgctctatttttaattgtgataagcctgtcagggtttataaatatcagtatagcaaccaagaaccagagtcgaaggaagttgagttaaatagaaccatggaaattaatggaaagaaatttgctacttatgagtctaataattatagagatagataccatatgattttaccaaattctaaaggttacttgcctttggattataaagagcgtgatttaaatacaaagacgaaacaaattaatttagatttaacaaaagcctttactctctttgagattgaaaatgaactttcctatggtggtgtttacgcgaaaacgaccaaggaaatggtgaataaagcaggatattatgggcgtaatcctacttggtgggcggagagaacgttagggaaatcattgcttaatggattgagaacgtgtaaggaagattcttcatataatgggctactatgtcctcgtcatgaacctaaaacgtctttcttaattcctgtagaaacaacaactaagtctttatattttgcagacaatatcaagttgcacaatatgttgagcgtagatttaggttatcgttatgatgatattaaatatcagccagagtatattcctggtgtaacacctaagattgcagatgatatggtcagagaattatttgttccactccctccagcgaatggaaaagattggcaaggaaaccctgtttatacacctgagcaaattcgtaaaaatgcggaggaaaatattgcttatattgcacaagaaaaacgctttaagaaacattcttattctcttggggcaacgttcgatcctctgaattttttacgagtacaagtaaaatattcaaaagggtttagaaccccgacttcggatgaactttattttacctttaagcatccagattttacgattttacccaacccaaatatgaagccagaagaggcaaaaaaccaagaaattgccttgacttttcatcatgattggggctttttcagtacaaatgtatttcaaactaaatatcgccaatttattgatttagcttatctaggatcacgaaatttatctaactctgtgggtggtcaggcgcaagcaagggattttcaagtctatcagaatgtaaacgtagatcgtgcaaaagtgaaaggggttgagattaactctcgcttgaatattggttatttctttgagaagttagacggttttaatgtaagttataagtttacttatcaaagaggacgtttagatggtaatcgaccaatgaatgcaattcaaccaaaaacctctgttattggattaggatatgatcataaagagcagagatttggagcggacttatatgtaacccatgttagcgcgaagaaagctaaagatacttataatatgttctataaagaacagggatataaagatagtgctgttcgttggagaagtgatgactatacgctagttgattttgttacttatataaaaccagttaaaaatgtgactttgcagtttggtgtatataacttgacagaccgtaagtatttaacttgggagtctgctcgttcaattaagccatttggaacaagtaacttgattaatcagggaacaggtgcgggtattaatcgtttctattcacctggtagaaactataaattgagtgcagaaattacgttttaattaaactagagaaagcctgtgaaacaggctttctttttgcgtgaaagtgcggtggatttgacaaagatttatttaattaagagttggaagtagtcttgtatatcttccaaaatatctgcctcatcttgaggtgttaaaatcaagaaagggcgtgcaggaatcgctactttacgacctcgtccagctttaccgccgaattgatgaatagccgcgtaaggctcattcgtccccacaatggcttcattgttgttatattcagaagtaatgctcgccatcaagttttcagtatccaccaaaggcgtaccttggcgaatctttaatttcttccacgcaggacgaccacccacttcaaagttctgcgcgacagccgattccattgtgcccgcaatgctacgcattaaaggagctcgatgagcggtggcttgtgcaaggcgttctagtgccgatgtaatttcttgtgcgttattgatttcaatttctatcataatcgttgatttttaaaatttaagggggtatattttagtacgcacttagaaaagcgatgaatctcccagatcgcaagcgaagaggtgaaatagactcgggactgtgtgtaggtgtggggagccctacctaagtgcgtaatccttttctaatagctttttaagctccttgtcttttattcgtctaaacgacagcacaaagatttcttttggtaatattttcactacaagcattttcccttgtcgaataaaggtgtaacgatctgcaaaatctttcacttgtagtaaatgctcgggagcattgatgatatctggcaacgctcatactcatcaatcccaaaatcttgcccatcacggctattaaactgtttaattaaagtatcatcagaaagccacactgtgccagttttgcttttcaataaatccttactttccgcactcaagacacctgccgcaaatttaaaatttttggtaaggctatctcgcacctgtaacatctgctcagcagtgagtttttttccttcagggctgagcgtttgtttcatctccgccatatgctttgccaacaattcaaaatcgtgcttaaactccccacctttcatctcaaccttcgcaaacgcatgcgccagtttttcaggataaagatccaaattaggcttgtagtttaatcgccctacattgtaatcaaagcctttatccgtcacacgtatcgtgccatcaggcaatttaaaccctaccgtcttttcacgattaccttgcttatctgctgggcgttctacttccaccaaaaattcagaactgtcgtcaggcttatcaatcccacggcgtttcaaatctctttcgcctaaccttcctgcggttcaggaatccctaatttatcccacacccaactttccgaaatctgcacgccaatgcccgtaagtttagggatggcatctgcaaataccgataagtcttcatattcttttgtgtcaaactcaaaataagggatacgatgtggcgcaatattcggatcaacattaatttgcaaatacggcaaaatgatttgttgagtgataatttgcgcaaggtggcgcaatgacaaaacgttgtgatcagcctatttgtattgagtatgaagaatgcgaaccgaataaatacggtgagattcgtaagaaaattgtgggggtaaaaaacagattcacagaaaagaaaatcatcaccaaattaaaaaactgggtgattaaatcagcgaaaagtgcgttgggttccaccgcacttaattcggagaccaccgaacaaacaaggcgcatcgagccgcttggacttgtgtcaataactgtaaccgttcaaaaattgaacatcaagctaatctattgatgttgcctatcggttcgccattaaaaccgtcacaaattgaccttttaatgctccatggacggttacagcttaatgactatcggtggatttgttgtgaaaacgatgaagttttcattaaagaagaaaaaattccgttggctcaagcctttggttggggtcagatcataacccgcctttgttttatagccttctgccatatcaggtgcgtaataagtattttgcagaatactgagatctctatggcccgatattttggctaataccattacatccactttttctgccaatcgttcacggcgggtgtcgtgaaaatgtaaattggcattttcaagcccttccatctttttgagcttgcggaagttgtgatccagttggcgtgcttccatttggaatactcgcggatcactttctgtttttaccgaagtaagatgttgtaaaatctctattgcttttaccgaaagaggcaccgtgcgtgaatgtccatttttagtaattggcaaaaaggtggtgcgcttttcaaaattaatattattccaagttaaacttgctatttcccctgctctcattgctgtctctatagcaaaaagaaatgccgcccccgtgcaattttgtaaggtttttggcggttcaatatgttcgacatcataacctgacacaaaaatcagacgctcaatttcatgttcattatatcgacgagttcttggtgctggcgcttttggtttctcaagatattttagggggttttctgttataaaatcccattcaatcgttttggccattagagcagaaagcgaactacgttcacgcaaaactgttgttggagagacttcttttaatcgttgattttaccactcacgaaagtgtgcttttcctatttcttgtaaagatattgcggcaagcggagttcgagaaagacgcagtagtcttatgcgctcttcacgtttcccgcgcttggttacagtgacttcttttagatacttatcaatgagttcatccaatgtaatatcagggatttcattatactttcctgattcaagctgtttttcgagcatttctgcccatttttttgcgtctgcttgagtcaaaaaaatggctgatttgctcacgccaaacttgcgcacttgtgcgtgccaacgcttgccattcttgataattgtcgccatggtttattccataaaaatgtgtgcaatggagtatagaacagatcgaaatcgatcccaatcggtataaaaatactaccttttaggcgattttgatataaaaaagaaggtatgttttagtgtgttaaattatataagctattgtttttacttatattttatctatttttatctgaaaattggggaatagagaaaaatagagatggtgcgactagctggactcgaaccagtgacccccaccatgtcaaggtggtgctctaaccaactgagctatagtcgcactgtgtgaagtagtcgtgattatagatatttttaacttgaacacaagtatttttcttaaaacccgatataactggcaaaaaagtaaacaaaaccagcttaaataactgagccgtttttgatttccaaaagttttaagcgtataatgtgcaccgattttttatctggctaatatgtagcgaagtaaaataacacctttaaaattttgtaattattgacggagtaaataatgtctagaagactaagaagaacgaagattgtatgtactatgggcccatcaactgaccgtgataacaatcttgaaaaaattatcgcagcgggcgcaaacgtagttcgtatgaacttctctcacggtacacctgatgaccatatcggacgtgctgaacgtgtacgttctattgcgaaaaaattaggtaaaaccgtggcaatcttaggtgatttacaaggtcctaaaattcgtgtttctacttttaaagacggtaaaattttcttaaacgttggcgataaattcattcttgatgcagagttaccaaaaggcgaaggcactcaagaatccgttggtttagactataaaacgcttcctcaagatgttgtgccgggcgatattcttttattagatgatggccgtgttcaattaaaagtattatcaactgatggtgcaaaagttttcactgaagttactgttggtggtccattatcaaataataaaggtatcaataaattaggtggcggtttatctgcggatgccctaacagaaaaagataaagccgacattattaccgctgcacgcattggtgttgatttcttagccgtttctttccctcgttcaagtgcagatttaaattatgcacgtgaacttgctcaacaagcaggtttaaatgcaaaaatcgttgctaaagttgaacgtgcagaaaccgttgctaatgatgaagccatggacgatattattttagcctctgatgtaattatggttgcacgtggtgacttaggtgtagaaatcggcgatcctgaattagtcggtgtacagaaaaaattaatccgtcgttcacgtcaattaaatcgtgctgtaattacagcgactcaaatgatggaatcaatgattagtaacccaatgccaactcgtgctgaagtaatggacgttgcaaacgcagtattagatggaactgatgcagttatgctttctgcagaaacagcagctggtcaatatccttctgaaacagtggcagcaatggctagcgtatgtttaggtgcagaaaaaatgccaagcattaacgtttctcgtcaccgtatggataaagaatttgaaactattgaagaatctgttgcgatgtctgcaatgtatgcagcaaaccacatgaaaggtgtagcggcaatcgtcactttaagtagcacaggccgtactccattattaatgtcacgcattagctctggcttaccaatctttgctttatctcgtaatcaagaaaccctaaacctttgtgcactataccgcggtgtaacaccaatttatcacggcgaagaaagtcgtacagaagctggtgcaaaagcagcacctcaatcattaaaagaaaaaggttatttatctactggcgatttagtgctggtaacccaaggtggtcaaggtgcgacacaaactaacgtatgtcgtacattaattgttgaataatcaacaatctaaatatgttaaaataaaagagcggtggatttttccaccgttttttatttccttttttcaccgcacttttcacttaaanccaatagatatttgcggtatcatagacgacattctagtatcgaaataagtcctatggcatcacaacctcaaatcaaatcttcagacaaaaaaacagcacaagttagcattcctccgcactcaactgaggctgaacaagccgtgttgggtggcatcatgctgagcaatcaacattgggatggcattgctgaacgtgtgattgctgacgatttttatacttttcagcatcgtctaatttttacagaaatggaacatctaatgcgtaatcaatcgcctattgatttaattacgctagatcaagccttaagaagccgtggtgtaagcgatgaagtaggtggatttgcctatctagcagagctttccaataatactccgaacgccattaatattttggcttatgcagatatcgtgcgcgagaaagccatattacgagaacttatttcggtagggaatcgcattgctgaaaatagctattctcctaaagggcaagacattaagttaattcttgatgaggctgagcgtgaagtatttgcgattgcagaaaaacgtacgacttctagcgaaggcccacaaaatgtgatcaatgtgctagaaagtacgattgaaaaaatcgatattttaagcaaacttgaaaatcattcaggtgtaacaggtgttacgacgggctttaccgatcttgataaaaaaacggctggtttacaaccttctgacttaattatcgttgcggcacgtccgtcaatgggtaaaaccactttcgccatgaacctttgcgaaaatgccgcaatggcaagtgaaaaacccgttttagtatttagtttagaaatgccagcagaacaaattatgatgcgtatgatcgcttcccttgctcgcgttgatcaaactaaaatccgaacaggtcaaaatttagatgaaatcgagtggaacaaaattgccagcgtagtaggaatgttcaagcaaaaaaataatctttttatcgatgattcttcaggtctaacacctaccgatgttcgttcgcgcgcacgccgagtttatcgtgaaaatggtggattaagtatgattatggtggattatttgcaattaatgcgcgcaccagcattttcagataaccgaacactagaaatcgcagaaatttctcgctccctcaaagcactcgccaaagaattacaagtgccagtagtcgccctttctcagttaaatcgtactttagaacaacgtggagacaaacgccctgtaaactcagatttacgtgaatctggctctattgaacaagatgcagacttgattatgtttatttatcgtgatgaagtctataacgataactcggaagataaaggtgttgcagaaattattatcggtaaacagcgtaacggcccaattggtcgagtgcggttaaaatttaatggacaattttcacgcttcgacaatctcgccgaacaacgtgaatatcgagatgattattaaggaaaaataatgaacgtaaaaccggcgacagcgaaaattagttcgcacgccttaaaacagaatttagaaataattaaacaaaaagcaccaaatagcaaaattattgctgtggttaaagcaaacgcctatggtcacggcgttgtattcgttgcttcaaccttagaacaaaatgttgattgctttggcgtggcgcgtttagaagaggctttagcattacgctccaacggcattactaaaccgattttattgcttgaaggttttttcaatgaacaagatttgcctattctagccgttaataatattgaaaccgtggtacacaatcacgaacagcttgatgctttaaaacgtgcgaatttaccaagtccaattaaggtttggttaaaaatagatacgggaatgcatcgcttgggcgttgctcttgatgaagtggattatttttatcaagaactgaaaaaactccctcaaattcaaccgcacttaggctttgtcagccatttcagccgagccgatgaactagaatcagattacacccaacttcaaatcaatcgttttttatccgtcacaaaagataaacaaggtgaacgtactattgcagcgtcaggcggcattcttttctggccaaaatcccacttagaatgtatccgcccaggcattattatgtacggcatttctccaactgatactatcggtaaagagtttggcttaacgccagtgatgaatttaacctcgtcattaattgccgttcgccatcataaacaaggcgatcctgtaggttacggcggtatttggacaagtccacgagataccaaaattggagtggtcgcaatgggttatggcgatggttatccgcgcgatgtgccagaaggtacacctgtttatttaaatggccgtcttgtaccaattgttggacgtgtgtcaatggatatgcttactgttgatttaggcgcagatagccaagatttggtaggcgatgaagtaattttatggggcaaggaattacctattgaaaccgtagctaaattcacaggcattttaagctacgagctaattacaaaattaacacctcgtgttataactgaatacgttgattaatcactgcattttttgaacagagggagtcattctccctaataaaaattccagaaagtgcggttaaaatttcaattatttttaatgaaaggaaataccatgaaaaatattaacccaactcacacccatgcgtggaaatctctcgaagcacataaagctgaattgtcaaacatcaccatccaagatttatttaaacaagaaaaaaatcgttttgacgattattctttaacattcaataaccaaattcttatcgatttttccaaaaacaacatcaatcaaacaaccctttcacatcttcgccaacttgctcaagaatgcgcgcttgatagcgcaaaagaagcaatgtttaccggtgaaaaaatcaatcgtacagaaaatcgtgccgtactacataccgcactacgcaatcgcactaatacgccagtgcttgttgatggcaaagatgttatgcctgaagtcaatgctgtgctagctaaaatgaaagatttctgtcagcgtattatttctggcgaatggaaaggctatacaggtaaagccattacggatgttgtgaatattggtattggtggctctgacttaggcccttatatggtaaccgaagcacttcgcccgtataaaaatcatctaaatatgcactttgtttcaaatgtcgatggtacacatattgcggaaaccttaaaaaaagtcaatccagaaacgactcttttcttagtagcatcgaaaacttttacaactcaagaaaccatgacaaatgctcaaagtgcgcgtgattggttactaaaagcagcgaaagatgaaagtgcagttgcaaaacattttgcagcattatcaaccaatgctaaagatgtagaaaaatttggcattgataccaataatatgtttgaattttgggattgggttggcggtcgttactctttatggtcagctattggtctttcaattgcactatcaattggctttgaaaactttgaagcgttattaaatggtgcgcatgaaatggataaacatttcctctctactccaatcgaacaaaatatcccaaccactttagcattagttggtttatggaataccaatttccttggtgcgcaaacagaagctatcttaccttatgatcaatatttacatcgcttcgcggcttattttcaacaaggtaatatggaatcaaatggtaaatatgtggatcgtgatggcaatgtcattaaaaattatcaaactggccctatcatttggggagaacctggtacaaacggacaacacgcgttctatcaattaattcaccaaggcactactttaattccttgtgattttattgcgccagcccaaagacataacccattggcagatcatcacaataaattgctttctaacttcttcgcacaaacagaagcattagcattcggaaaaacaaaagaggaagtcgaggctgaatttgtaaaagcggggaaatctttggatgatgtgaaaaatattgttccatttaaagtattcactggtaataagccaactaattcgattctcgttcaaaaaatcacgccatttactttaggggcattaattgcgatgtatgaacacaaaatcttcgtacaaggtgtgatttttaatatctttagcttcgatcaatggggtgtagaactaggcaaacaacttgcaaacagaattcttcctgaattaacagattctgaaaaagtagcaagtcatgacagttcaactaatggattaattaatcaatttaaagcatggcgttaattatttggatttgaataattctagagctgtcacaaataacgactaaaaactctatttaggttaagataatcaaatgagagaaagtcgcttaagtcaatataaacaaaataaacttattgaaatatttctggcaagtgtgacagctctagccacagctaagttggtaaatataaataaacttcagcttattactttcatcgtctaccattgtttatcactcaaagcagcctacatatggaaatgtttgaaagtgaaattcaagcgaatgaaagctattttggtggtgctctgaaaggtaaacttggtcaaggagaagctggaaaaacttccgtaatttgttttttgaaacgaaatggcaaagtaacaccgtggtggttatgaatatgcaatctgcaacactgttaccgattattcgagaaaataaacaaggtagtattattatatgaatttctacagaggttatgatattcttaagctatatttaaaggaatatgaatggcgttttaatcacagtgatttaaaaaaactcaaatttctatttcaaaacaattaatttaggagagttttaattggttatctatgcatctccttttgttatttaaataacgtataaaatagtttaaagaagagtgtaaaattagagcttatatggaaaattgtccattagtatcggttattgtttgtgcttataacgctgagcaatatatagatgaaagcatttcatccattattaatcagacttatgaaaatctagaaattatagttatcaatgatggttcaacagatttgactttgtctcatttagaagaaatatctaaattagataaaaggataaaaattatcagtaataaatataatttagggttcataaattctttgaatataggccttggttgtttttcaggtaaatattttgcaagaatggatgctgatgatatagctaaaccatcgtggattgagaaaatagttacctatctggagaaaaatgatcatattacagcaatgggatcatacttagagattattgtagaaaaagaatgtggaattatcggttctcaatataaaactggagatatatggaaaaatccattgctacataatgatatttgtgaagctatgcttttctataatccgatacataacaacactatgattatgagagcaaatgtatatagagagcataaattaatctttaataaagattatccgtatgcagaagattataagttttggtcagaggttagtaggcttggttgtttagctaattatcctgaagcattagtaaaatatagactacatggaaaccaaacatcatcagtttataatcatgagcaaaatgagacagctaaaaagataaagagggaaaatattacatattaccttaataagataggtatagatataaaagtaattaatagtgtgtcgttgctagaaatatatcatgtggataaaagtaataaagtgttgaaaagtatactttatgagatgtatatgagcttagataaatatactataacttcactcttacattttattaaatatcatcttgaattatttgatttaaagcaaaatttaaagattataaaaaagttcataagaaaaataaatgttatattttagatagagtgttcagaaaggggaaccaaattccaagttttctaaaggactaaattctaatttagtcctttaaatttatcttagatagacgataatatatattttaaatgaatttaattataaaaaaatcagtgccttactaagttaagacactgattaatcatattagactttaatgctattggttatagcacagaaacatttaagcttgagccgccaccaacaaatacgaactcggcgaccaagctacaaaaactgctgtcagccttttgaacaacaacgatctcttgaccatcatctttcttaattacaagttcagcaccgtttacttgactcattttttcttcgattttacttccagctattgcaccgccaattgcaccaactactgctgcaatagcttgaccacgaccaccgccaattgtactaccagcaataccacctaaagctccaccaccaagcgtaccaactacaccttgattatcagcttgaattttaacagggcgtacagaaacaatcgtaccataagtaattgaacgcgcttcctttgcttgagatgcgctataaacatcaccgctgaaaatatcagtatttgcacaaccagttacactaaaagcaactaacagtgctaatgccatatttgtttttttcatataatattctctatattagaaggaattaaagtgggtttcttggagaaaaagttgaaatgtttttagtattaccattgtcagatactaaaacacaagcaccaacaactaaagttgaaccatacttatgcacaataacaacctcctatcctttctgctggttaccagaacaatcatttttacgaacagttaattttagatttttgccttccatttgactaaaaataatttgacctttataagtcccctcctccttttgaaaagcagaacaagcactcaagtctactgttgctaaacaacgaatgcaagtgataatttattcatttttactaaacctcaagtatttttttatagaataaggatgaaccttaatgcaagtatgatttactgttttatccgtaaaacttactgcaatagatggatttggtaatctttccccatccactttaggctcgctcactttaatggttaattgagttaattgtcccataaaaaatacatattaacacggttaatccattcatttatcgattctttcggtaaaaatggcattacaatctcaatatgttcccagccctcaattggatattttttatttttaggaagtggaagttcaataatatccacaaattgattggcaaatttaactggtttttctaattcaataagataaatcttacgaccattaacaatattatcagataaaattctaccgcactttaataaaagtatcagccaatttttagcactttgctcactatttacccgtaatgcaagatgatcaatttcatagtgagacagatctattgtcatttctttggctaaatgctgaatttttctttcaaatattgctaaatctgctgaaagtgcggttaaattttcctgtaaatttgtcattttgtccctttgagaaatatacaaagaacggtatcataaccgattatttttattattcaatttgaacataggaaaaaacgtgaatattcaatctattctatccgataaaattaaacaagcgatgattcttgcaggtgctgatcaatcttgcgatgcgcttattcgtcaatcaggaaaaccacaatttggcgattatcaagccaatggcattatggctgcggcaaaaaaattaggtttaaatccacgagaatttgctcaaaaagttttagacaatcttcaactatctgatattgcagaaaaattagaaatcgcaggtccaggttttatcaatattttcttaaatccaacttggctaacaactgaaatttcagctgcactttcccacaaaaatttaggtattcaagctaccaataaacaaacagttgtgattgattattcatctccaaacgtagcaaaagaaatgcacgtaggtcatttacgctctacgataatcggcgatgctgtagccagaacccttgagtttttaggtcacaatgtcatccgagctaaccacgtaggcgactggggaacgcaattcggaatgcttattgcttatcttgaaaaaatgcaaaacgagcatgcgagtgaaatggaattacaagatcttgaagccttttatcgcgaagccaaaaaacactacgatgaagatgaagtattcgcagaaaaagcgcgtaattatgttgtgaaattacaaagtggagatgaatattgtcgaacgatgtggaaacgtttagtcgatatcactatgcaacaaaatcagcacaactatgctcgcttaaacgtgactttaaccgaaaaagatgtaatgggcgaaagtctttataatcctatgttaccaagcattgtaaaagatcttaaaaaacaaggtttggctgtggaaaatgatggtgcattggttgtttatttagatgaatttaaaaataaagatggcgacccaatgggtgtaatcgttcaaaaaaaagacggcggtttcctttatactacaaccgatattgctgcagcaaaatatcgttatgaaacattaaaagctaatcgcgcccttgttttttcagatactcgccaaagccaacatatgcaacaagcttggttaattactcgtaaagcaggttatgtaccagatagtttctcgttagagcataaaaactttgggatgatgcttggtaaagatggcaaaccatttaaaacccgtactggcggcacagtgaaattggccgatctattagatgaagccattgaacgcgccactgtattaattaatgaaaaaaataccaatttatctaatgatgaaaaagaagctgtgattgaggctgtcggtattggtgcggtgaaatatgccgatctctccaaaaaccgtactactgattacgtttttgattgggataatatgttaagtttcgaaggtaacacggcaccttatatgcaatatgcctacacccgtattcgttcgatctttaataaaacagatataaattcaaccgcacttttggctgcacctttaactattaaagatgataaagaaagaacgcttgctattaaacttctacaatttgaagaagccgtgcaaactgtcggaaaagaaggcacgccgcacgtgctttgtgcttatttatatgaacttgctggcatcttctcgtcattctacgaacattgtccaattttaaatgctgaagatgaatctataaaattaagtcgtttgaaattagcattattaacggraaaaaccttaaaacagggtttaacgttactcggtattaaaaccgtagaaaaaatgtaatttagataattaaaatccctttctcaggaaagggattttttatacttgtttactgaataaaaaaaagccccattggggcactactcggaaagcaaaatagatgtcggctatttaagatagcacttgtttttagtggtttcagawtaaagaaatccgatcagttatgcaaatacatatttttagatttgtgaacttggtcacgatttttttataaaaaaactaaaaacaaatatatttctaataaagtgcggtaaaattctattaaaatatttccgcactttacgcccctactttaaagaatattcttttctccacgagacacactaatcaatccagaacgaacaatttctaacaatgtagtttcttctttcaatgcagaaataaacgcatcaactttatcatttgtaccgcttaattgaattgtgtaagactttggtgttacatctacaatttgaccgcggaaaatatctgctaatcgtttaatttcatcgcgagatgaacctactgctcttactttcgctaaaacaatttctcgttctatatgttcctgctcacttaaattaaccactttaaacacatccactaatttatgaagttgtttttcgatttgctccaatgcctgagcatcgcccacagcttcaatggtcattcgagaaagcgttggatcatccgttggtgcaaccgtcaaactttcaatattaaaggcacgttgagagaataaaccaacaacacgcgacaatgctcccgattcattttcgagtaaaacagataaaattctacgcattagtttgtctcctcttgaggtttacttaaaatcatttcattcattgcaccaccacgaatttgcattggataaacgtgttcagattcatctacattaatatctacaaagactaatttatttttaatactgaatgcttcttgcaatttgctttcaagttcatcgggggtagcaatttttattcctacgtgaccgtaagattctgccaatttcgcaaaatcaggcaaggaattcatataggtttgcgaatggcgaccagaataaatcaaatcttgccattgttttaccattcccaagaaatgattattcaaacaaataatgacaacaggaatgccatattgtgttgcggtagaaagctcttgaatattcatttgaatactaccatcgccagtaacgcaaacaacagttccttcaggatgagctaatttaacaccaagtgccgcaggaaaaccaaaacccattgtgcctgcaccaccagaattaatccaatgacgcggttcatcgaatggataatgtaacgcagcaaacatttggtgctgacctacatcagaagccacataagcttgtcctttcgtgaggcgatataccgcttccacgacttgttgcggtttaatcacgccagaagtgcggtcaaattccaaacatttttttgctttccattggttgatttcttgccaccaactttcaagatctgtttgagattttaatccctcttcattcaataaacccaaaaattcttccaatacatttttcgcatttccgacaattggaatcgctactggcacatttttagaaattgaggttggatcaatatcaatatgaatcacttttgcatttgggcaatatttttctaaattatttgtcgtacgatcatcaaaacgaacgccaatccccaaaataagatcactttcgtgcattgccgtattcgcttctaaagtaccatgcatacccaacatacctaagaattgtttatccgtacttggataagcacccaatcccattaatgaggaagtcacgggtaaatttaaacgttgtgcaaactgaattaactgctcactacattcagcagtgattgcaccaccaccgacaaaaagtattggtttcttcgccactaaaagtgcttttaacgcttttttaatttgacctttgtgtccatttactgttggattataagaacgtaactcgacatattcagggtattcataaggatatttaaaattaggatttacagtgtcttttggaatatccacaacaacaggacctggacgacccgtagatgcaatataaaaggcttttttcaaagtagatggaatatcttccgcctttttgacaataaagctatgcttcacaacgggacgagaaatacccagcatatcacattcttggaaagcatcactgccaattaaattgctcataacctgacccgaaatgataaccataggcacagaatcggtataagccgttaaaatgccagtgatagcatttgttgcaccaggccccgaagtcactagcacacatccaactttacccgttgaacgtgcgtaaccatccgccatatgcaccgcggcttgttcgtggcgaactaaaatatgttcaataccacccagcgtatganttgcatcataaatatctaataccgcgcctccgggataaccaaatacatactctacgccttcatcacgtaaagattgaaccaccatctctgcgccagataacttcttcatttttcactccttaaattcaccgcacttttaaaaaaacgaacagattatgtcaatgtttcacataatacaaagtaaaaaaaatttgtctagccactaaaacaacaaaaaaatcaattaaaaaaatataaaaaaccaaatataaatgaaaatttagttttttataaatttttccatcaataaaaataaaaaaatgcgacaaaatgccgcattttataaaatagtaaaaatattattttttattcaaatttttgaatgagatcacagttttagcgttttttaactgcaaatataatgacaatcaatgaaactgccgttgctgcaaaaccagctaaacctgaataagtaaaccctaccacaatgtaaccaatagaagtcgctgttgcaactgtggcagcataaggaagctgagtagtaacgtgatcaatatgattacattttgcgcccgttgaagacaaaattgttgtatccgacactggcgaacaatgatcgccacatacagcccctgccattactgcagataaacaaggaagcaataattctggtgcggcattcgctgccattgctgcggcaattggtaacataataccgaatgttccccagctcgtacctgttgaaaatgccatcgctgcaccaagaacaaaaagtataacaggcaaaaattgcattggaatattaccagacacaagagaagatagatatttacctgtttgcatatcacctactattttattaattgtccaagcaaagaataaaattgcgattgcacctgacattgatttaattcccacaatccaagaacgtacatattcaggaacactcacttgacgatcaagaataattaataaagtagaaataataattgaacagaatccacctacaaccaaagatgttcctactacggtgttttcaaatgtacctaaaacactaaacactttgccatccgcagccaatgcctctgcgcctgtgtaaatcatcattgaaactgtagcgataattaaaactaaaataggtaatataagattacgcacctgaccttttgtacccgtttcttcttccaactgatcttcagtatttttcaaagctaatttttcgtgacgcaccattgaagcaatatcaaaagaaaaatatgccacaaaaaacaccataataatggagaaaattgcatagaagttcattgaactcattgctacgaatgcaccaattggtgtgtactccgtgatcgaataagtcgctaataaaccgcctattaaagtaataatatatgcgccccaactggaaactggcatcattacacacatcggtgctgccgttgaatctaaaatataagcaagtttcgcacgagaaactttaaaacgatctgtcacaggacgagcaattgcgcctacagcgagactatggaaataatcgtcaataaaagtaacaaaaaccaatgatgccgctaataatttagcaccacgacgacctttaatacggctttgtgcccattcagcaaaggcacgattactacctgatacggttaaaagtgcggttaaaacaccaagcaataataagaacaaaacaatgttcatatttgaattgatttcaccatcggcataaaccaaagaaaccacattttttaccaaataattaaatgcgctgccgatttgccaatcgcttaacattaatgatccaataataatccccgcactaagggaaaccaaaacacggcgagttgctatcgccaaaattatcgccaacaaagcagggacgattgaccaaacagatgatgaaaaatcaataagttccattaaataatacctataattaatggagagaacggaaagcataggacagaataagaccagaacaaccgtagcactccatagttaatcagaaaaactatgacagtgtcgcccctttcgagcacgccaccaaccaaacaaaacgacttttatttgatttcggcaactattcctttcttttttcttcttcgttatccactctgaaaaaatacttataataattgcgcctctacttttgtagtgattggggagattaccgtaaaacaaacaaaatgccaacagattttataaaaattttataaactttaataaaaatataaagaaaataaacacaaaaaaatatatctgtttcgnccatttatttaataatagatatttacaataaattttattttctctattattaaataaattttcccacatttaatgttatttattgaggtttattatgaacgaattagtaagaggtttaacaaatcttcgtagtttacgtgcagctgtacgtgaattaacgttagaacaagcagaaaatgccctagaaaaattacaaacagctatcgaagaaaaacgtgctaatgaagcagaattaattaaagcagagacagagcgaaaagagcgtttagctaaatataaagaattaatggaaaaagaaggtattacacctgaagaattacacgaaatttttggcacaaaaactgtatcaattcgagcaaaacgtgctccacgccctgcaaaatatgcgtttattgatgaaaatggcgagcataaaacttggacgggtcaaggtcgcacaccacgcccaattcaaaatgcgttgaacaaaggtaaatcattatctgatttcgaaatttaatttttctatttgaaactagaacctattttatgggttctatttttttatctaaacatagcacacaacattatgatcgaaaaaaaaatattactcactgattgccctgatgataaaggcttaatcgcaaaaataactaatatttgttacaaacatcaactaaatattcttcataataatgaatttgtagattttgaaaccaaacatttctttatgcgcacagaattggaaggtatttttaacgaagctactttattagaagatctaaaatatagcttaccagaagaaacaaattgtcgattaattggcacccaacgtaagcgaattgtaattttagtcaccaaagaagctcactgcctcggcgatattttaatgaaaaattattatggtgcgcttgatgtagaaattgcagccgtaatcggcaatcacgataatttacgtgaacttgttgaacgttttaatattccatttcatttagttagccacgaaaacttaacccgtgtagaacacgacaaattactggcagaaaaaattgatgaatatacgccagattatattgttctcgctaaatatatgcgtgtgctaaaccctgaatttgtcgcacgttatccaaatcgagtgattaatatccatcattcattcttgcctgcttttattggtgccaagccttatcaacaagcctataaacgcggtgtaaaaattattggcgcaacggcacattttattaataacgaattagatcaaggcccaatcattatgcaaaatgtgattaatgtggatcatacttataatgcagaagcgatgatgcgtgctggccgtgatgtggaaaaaaccgtgttaagtcgcgcccttgatctcgctttacacgatagaatttttgtttataaaaataaaacggtggtgttgtaatggaaaaaattactcttgcaccaataagtgcggttgaaggaacaattaatttaccaggttctaaaagtttatcgaatcgcgcattacttttagccgccttagctaaaggcacaacaaaagtaaccaatttattagatagcgatgatattcgacatatgcttaacgcactgaaagcattaggcgtacgctatcaactgtctgatgataaaactatttgtgaagtagaaggattaggtggaacattcaatatacaggacaatctttcactctttcttggcaatgctgggactgcaatgcgtccattaaccgcagcactttgcttaaaaggaaaaaccgaaagcgaaatcatcttaacgggtgaacctcgtatgaaagaacgacctattcttcatttggtcgatgcgctacgccaagcgggtgcagatattcgctacttagagaatgagggttatcctccgctcgcaattcgcaacaaagggataaaaggtggaaaagtcaaaattgatggttcaatttcatctcaatttttgaccgcacttttaatgtctgcaccacttgcagaaaatgacacagaaatagaaattatcggtgaactagtctctaaaccctatattgacattacccttgcaatgatgcgagattttggtgttcaggttgaaaatcatcactaccaaaaatttcaagttaagggaaatcaatcctatatttcgcctaataaatacttggtagaaggcgatgcctcatcggcatcttactttctcgcagctggcgccattaaaggaaaagtgaaagtaacaggcattggcaaaaactcaattcagggcgatcgtttatttgctgatgtattagagaaaatgggggcaaaaatcacttggggagaggattttatccaagccgaacacgctgaattaaatggtattgatatggatatgaaccacattccagatgccgcaatgacgattgcaaccactgctctttttgccaacagcgaaaccgtcattcgcaatatttataactggcgtgtgaaagaaacagatcgtttaacggctatggcaaccgaactccgtaaagtcggtgcagaagtcgaaggaggtgaagattttattcgtattcaaccgcttccactcaatcaatttaaacacgccaatattgagacctataacgatcaccgtatggcaatgtgtttttctctaatcgcactatcaaacacaccagtgacgattttagatcccaaatgtactgccaaaacctttcctacattcttcaatgaatttgaaaagatttgcttaaaaaattaagtaaaaaagtgcggtcaatttcaaaacagttttcaaattaaccgcactttcattccattctaaaaaaatcctaaataaagattatttataccgttttttcaccgcacttttatcttgctcacgtaaccgttctagtttttccttaatctgaatttccatacctctatttgtcggaaaataatattgagtatcttttaattcaggtgggaaataattttcgcctgccgcataagcgttaggttcatcgtgagcataacgatattcagtgccatatccgagctctttcattaaattagtcggcgcattgcgtaaatgtggtggaacatcgtaatctggcaaatctttcgcttgctgtttcgcagtgttaaatgcagtataaaccgcattactttttggtgctaccgaaagatatataatggcttgggcgatggctcgctccccttcataagcccccacgcgactaaagcaatcccaagcagccaatgcaacttgcatagcacgaggatctgcatttcccacatcttctgaagcaatggcaagtaatcggcgcgcgacatataaagggtctccacctgccgttaaaattcttgcataccaatacagcgcagcatctggagcagaacctcgaacagatttatgtagcgcagaaattaaatcatagaaacgatcaccttgtttatcaaatctcgcttggcgttcgcctaagacttcttttaataaagtgcggtcaattttctttccattttccgtttcatccgccatatccaccattaattcgaggcaattcaaagctaatcgtgcatccccattaacatattcggcaagtacttgcagtaaattctcttctaaaattaaccgctctttacccaatccacgtttaggatcttctacagcttgctgcaaaacttgttcaatttcagccgttgtgagtgatttcagcacatacactcgggcacgagaaagcaacgcattatttagctcaaaagagggattttctgttgtcgccccaataaaaataacggttccgtcttcaatgtgcggtaaaaatgcatcttgctggcttttattaaaacgatggacttcatccacaaataagatagttttacgatccgcaagacgattttgttttgcacgatcaatggcttcacgaatttctttgataccactcgtcaccgcagaaattcgctctacttctgcattaatacgttgtgctatgatttctgcaagggttgttttccccgtacctggtgggccccaaaaaatcatagaataaatatgaccagcttggatagcttttcgcagtggcttgccctcgccaattaaatggctttgcccaaaatattgttctagactcgttggacgcatcttggctgccagtgggccaaaatcattttcggsaaaatcaaaattgaagttagacatttttatttctcaaaaaattgaagggcgtatttctacgcccttatttaaaataatcacttgttattttttacgttggtcatccacttcaacgcctttttctggcttgaattggaacaagctatcagacaaggtttgattcgtaatattacgtaaaacataaagattggtttgcccatctttctctgtcgtactgaaatttcgcaatattccattagcatcaacacgaatatcaaattgcttaatgttgcttgtggataaggttggttttaacacaaaggtatccgattgttgtgttaccgtatattgatgccaatggctcttatcattgctggtaagcaaaacaaaaggagtattatttaccgcattttttacccattgtgcggtcacttgttgcacaaatggatcgtagaaccataaggttttaccatcagaaataatctgggtttcttgaggggttttagtctccatacggaataaatttgggcgtttaatttgaagtttgccacttccttgttgaacattttttccacttccagaagtcactgtttgcacaaattctgcacttaatacatcgactttagctaaacgcatttgtaattcacttgccgcatcagccaatgccaaattactcaaaccaagtaaggtaagtgcggcaaattttaaggttgtttttttcattttactttccttttaaattagtattctggacgatgcgataaaatttcacgcttaccattttgcattgggctgacaatcccttgttcttccatttgatccataatacgcgctgctcggttaaaacctacgctgaatttacgttgaatagaagatactgaagttgtaccagtattaataacaaagtccattacttcatcaaagagtggatctaattccccaccgcttgatatccctttttctgaactttcctcatcgtctgcgctttctaaaattccatcaatataatcaggtttaccgcgtgctcgccaatcatcggcaatattgatgacttcatcatcactcatataggctccatgtacgcggattaaatcagatgaaccttgtccagaataaagcatatctccacgccctaaaagggcttctgcacccccttgatcaagaatagtacgtgagtcaattttacttgccaccgtaaaggcaatgcgacttggaatatttgctttaattaaaccagtaatcacatccacagaggggcgttgtgtggctaaaattaaatggataccgatagctcgtgctttttgtgccaaccgtgcaatcagttcttcgatttgcttacccgctaccatcattaaatcagcaaactcatcgacaataaccacaatataactcaattttttcaacgctggtggcattgcatccatcgtatcgcccagtcgccaaattggatttggcacaggcattcccattgcttcgtattcatcaattttttcattaaagccttcaatgtttcgtacgcgtaaagctgaaagcaactgataacgacgttccatttcatctacgcaccaacgcaacgcattagcggcttttttcatatccgttacaactggtgtcagtaaatgtggaatatcattataaacagaaagttcgacgactttaggatcaatcataataaatttcacatcttctggttgaacacgataaagtaaacttagaatcatcgtattcacaccaacagacttacctgatcccgtagaacctgctaccaataaatgtggcattttcgctaaatcaacaatgactggtttgccactaatatctttacctaaagcaataggtaaagttgccttgctatcacggaattcattgctatctaatacatcacgtaatggcaccatttgacgatgaagatttggggtttcaataccaatataaggtttacctggaatcacctctgccacacgaatagaacgaaacatcaatgctcttgctaaatcggtatcgatgctcgtgacttttgatgctttcacacccggctgtaattctaattcataacgcgtaacaacagggccaacaagcacatcttttacgctggcttttacattaaaattgcgtaattgttgttcaatacgctgtgaggtttccattatttcatctggtgtaatgcgttgttcatttggcggatattttaaaagcaaatccaaactaggtaatggtgtactcggtttttcacgttttgttgtttgctgttgaaatgcaggatgaatcaagctaccgctataacctttataattaggctcttgatttttgtctaattgaacggcttccatatcatcctgtaagataggttaaatttcactccatctttttctaaatctaccttttcattaacttgagtagcaaaatgattatctaccatttcagtattcaaagattcatgactgggtcttaataaaactgttggcatttcatcttttgttagcaaagaaacttgagtaaaatcatccgcactttgatttaattgctaaatcttcttgaacaactgtttttacaggcttattccaaactgcgacaaaatcatttttgcttaccctttgttcatctgaatcactcgataaattcacactaggcaagctttcagaatcaaacccaaaagaaaattgcggtttttcattctcttcgttcgcgagttcatattctgattttatagaaacctctggatttaacccgctaatattaattaaatgtgatgaagatttgccaattgaaatattttctgcttctaaggatggctttactgtttctatttcactattttgttctacattgagataattttgatctagattttctgtttctgaacgatctgattttacaatcacaatttgctctaattcttccgttgatttttcttgctcagcattttctgattgctcatttttcattgttagccaatgataaaatgtaacaattaatcgaattaatgatgtgccagaacaaaaaataaaaccaattaaagcaagcacaaaaccaattaaaattgaaccaaatttacctaatacaggataaaaccaatttacaacaagcgatccgcccaatacgccgccactcaaataaaaagtattacttgataaaagcaacatactcactacacaaagcccaataatcagcatggtaaagccaaaactaccgtaaaataattcgagtacaggaaagctgtttaactgcttttgttttcaataaataaataggcacgagaaaagcggtgaaaggaataatatgggcaacataacctaaaaaaacaaaaaaaagatcgattatccacgccccaaatgaaccgactttattaattgtgttgccatacgcactgactgttgcccaagaattatcaaggggcgtataacttgaccaagcaacaatcaaataaagtccaaaaagtgcggttaatcccagcaaaaattccgctaaatactgtcttggcgtaaatcgttctgtaatttgtttaatcatattatttcaatacaaggaaattggtttgttttacttcttccatcacaacataagtgcgagtgtcatttacacctggtaaacgtaacaatgtcgtgcctagcaattttcggtattccgccatatctgccacacgagtttttaataaataatcaaaatcgcccgataccaaatggcattcttgaatttcttccaacgcttgaatcgctgcattaaattcttcaaacacatcgggcttaccccgtactaatgtaatttcaacaatcactaacaatggcgcatccaataattctggatttaacagtgcgcgataccccataatcacaccttgtttttccaaacgtttaactcgctctaaacaaggtgttggcgaaagccccacttttttcgacaaatcaatattggaaatcttaccgttgcgttgtaattcattcagaatttttatatctatcgcatccaatgctttatttcgttttttttccattttctttatttctttgctcataaaaaggaacaactattctacagaattttcctttcattttcagtaggcgatgatttttttacaaattatctaacacagcgagcgcatccgtgagttttttcacagtaaaaacctgcatattttcgaccgcacttttcggcttgttaccaaaaggaacaatagcacgtttaaaaccgtgttttgcagcctcgctaatacgttcctgtccacttggcacaggacgaatttctcccgctaatccaacttcgccaaaaatcactaaatcttgcggcaaagggcgattacggaaacttgaaattaacgcaagcaacaaagctaaatccgcactggtttcactgacttttacaccaccaaccacatttacaaaaacatcttgatccgccatttgtaagccaccatgtcggtgtaacaccgccagtaatagcgctaagcgattttgctctaatcccaccgcaacacggcgaggatttgccagcattgaatgatctactaaagcttgaatttcaactaaaagaggacgagtaccctcccaaagtaccataacagaactgcctgacgtaatttcatctccgcgacttaaaaaaatcgccgatggatttttcacttcgcgcaaaccctgctctgtcattccaaacacgcccaattcatttactgcaccaaaacggtttttatgactacgcaaagtacgataacgagaatcggcttcgccttctaataacaatgaacagtcaatggcatgctctaacactttaggccctgcaagggttccgtctttcgtaacgtgtccaaccataataatcgccacttggcgagtttttgcataacgagtgagaaaagaagcgcattcacgcacttgagctacactgcctggcgatgattgaatatctgccaaatgcattacttggatagaatccaccacgataatttgcggttttaattgatccgctaaattacaaatctgttccacagaggtttctgacaacatttttaattgatcacttggcaatcccaatcggcttgcgcgcatcgcaacctgttgtaatgattcctctcccgttacataaagtgcggtcatattttttgccaaaccacacataacctgtagtaacaatgtacttttccctgctccaggatgcccaccaattaaaatcgcactacccggtacgatcccgccgcccagtaccctatctaattcactaaaaccactggaaaaacgtggtgtttcttgcaaactaatttcagagagcgtttgaatttttgcctgagtttcacccgcatagccactaaaacgatcattttttgattttgccgtggaaattaaccgcacttccgtaattgtattccacgctttacaagcggaacattgcccttgccaacgagaaaactccgcaccacaatcgttacatacataagctgtttttggggctttagccattttattctccgtatttgccgtggataacttcccgtgggtaagtatacccacggttaattatagttatagtggttcccctttggggaacatcaaactaccccaacggagtagcactgagatcagcctagggtatacctaccctaggtcataagataattccattaatttgatcattcgctcaaaataaactcgacttttcaaaagtgcggtcaatttttcaatagttttttcattgtctttcgtttcactatgaaaacgaatcaaatcacgaatttcaacaaagattttctgattgctttctaacaaagctggtaagcgcgtttctttttgtttttctgttgccatcgcttctaagattttcccattttcatcataataatgataaagattaaaaaatgccccgactcgctccactgttttcataaaatcttggctaaaaagtgtgggagaaaatgataaggtttcttccaaaagtttctgttccattttaagcaccgcattaaattttgcacaaaaatctaccgcactttcttctcgttcttcttttaagaaatcacgccatttattgagccaatctgttaaaaattgttttgagcccagcaaataancncgcttcgctttacttgcactactaaaataaatatctctttcgaaaggcaaagtttccacaaaatcaaaaagatcctgcacattgccagatttcaattcaaactcaatttcactgataggttgctcatattcgcctgcaataattttgccttgatcgaaagccacttcaattttagattgttgaaattcaactaaccaaaaagtgcggttaaaatctgtggagaaaataggttgtagtgtagagctaggtaattgttcaaaaggataaagccctcttaattgggcattagttggcgtttctttttcgattaatggtaaattatattctgggcgactatgcaatccactaacaactttaccgttagttttaagtgttaatgtaagttcttgatcttcttgacgaatacgcaaccccattttttgtttagcaagaaaatgatcgggataatcataataggtgttacccaaaaataaattttgatgttctaaaatcgtaaattttgcaagatattgtggcaattcaatacctatttgtggcgaaatcgccaattttaattcaatttcttgtaacataatattctccatttaaattaactggttaaatatacaatacaatagaaataaatcaagatttttgtggtgttttactttacatattaaatagctataaatgaatttttatttattgtgattaaaatattgcgacttttaaataaaaaaataatccgaaaaacataaacagatttcatcggataatattgataattttaaataacaaagccagattaaaatgtgaatatttactaatctaaattagcaataattgtgaaatgtcaattaaaataagtaagatgaaaatatgaatattttcatcttactcagcattttcaaaaattttatctttgttcggggtaaattacttcagatgtaacccatttcatccatacttgctctaataatgggattattgaggtactgtcttcaaccattgtattaagagcagacaaaacattttctaatgaatttggttgttcttgtagataacttaacaaccagtaatctaactctgaaaggatttgttgctgaatcctaaaatcactatcacgccatataatagcttgaattggcgtatcatcaaattgtttaaagtcacttgataaaaaatcaacgtcataactttttaaataagctgcaccagataattgcattacgctatgtctattccactcaaatttttcaggcactttggctaaagaaacttctgcgagtaattgtgtattttcaaaatccatcaatgccaatatatttgtatcaaatatctctttttcttgacaaaacaagagaaattctcctgcaatatcttggaaataaggagaatgggcattaccattttgcacaaaattttctttagcatttttccaatactctggctcaatatgcaatggtgcttcaacaaaacaacgatcaataaaaccaaaagcattattacgaactaaacgtgtatataccgctaaacggcttgcagcataaccatttaaaggatctgcattacctaaccgaatagcatttgccaatgcttgctgagtttctttcaatgatgacttaggcagcataagacattacctctgtgtgagcgtatttttgctgtaattgtgcaatatgctcaacttcggcgtaaagttctgcaaatggtgggaagttgaaatcacgctccaataatgttggaggaatcgtaggtagtcgttgataggcatattcgagtaaatcccatacagtgccttttacagcttctccgtgtgtatcaattaataattcaggtaaatggcgatatgctccttttactttattaaatgattcatttgctgaattctctacaacttgtgcagcagaatgttcttcatcgtgccctgcaatatgaatgtaattaacacgtttaacatcaacttgatctaaaaagatataaggatcaagtaatccgtgattaacaccattaacataaatattattcacatctaaatgaatgccacaatcagcctcttgtgcgatagcatttaaaaattccacttcattcattgtgctagtaggagaatgcaaataataagaagtattttctaatgaaatttgtaatcctaagaaatcttgcacatcacgtattcgttgcgcaacgtgttttactgcttcttctgtaaatggcataggtaataaatcatataaatgcccttcacattcacaataacttaaatgttcagaaaagaaagacgaattatattgattaattaatgctttcgtattacggagtaattcgcgatcaagtggtgcttgcccacctaaagaaagtgaaagaccgtgtactgctaacggaaatctttctgctgcttgatcaaattgataacgtgccattccacccattttactccaattttctggtgcgacttcaataaattgaatagcgttatttgagggaagttgtaaaaaatcctcagctaaattccgacgataacctagtccagcgccttgtaatttcataattaactcctttttaataaaagctggcataaattgttacgccagcataattattattcttatttagaaccgcatttaccttcgccacatttgccttcagcagatttagctttgtctgcaccgcatttgccttcaccacatttaccttctgcagatttagctttgtctgcaccgcatttgccttcaccacatttaccttctgcagcttttgttttgacacatttatcgcccacacaaggtgttgctgtattatcagtactgcttgactttgattcagcctgtgctgctgtcgctactgccatcgttaatgcacctgctaatgctgttaatgttgctaattttttcatttgaataatctcctagagtttgaattttgaataaataattagagaaatttcaaccagcttttagttggataaaccttcttaataagcgtgtctaaagagagtttccccgctccctgcgtaattaagattaataaagtcaccacataaattaatggtaatttataaccattatcacatacgttataacctgaatcggcgtgaatgctataccacgcgacagagattaaaatcgttaaacttaatgcactaaaacgtgttagcaccccaaatatcagcaagaatgggaaaattaattctgatcccattgcaacgtgccaattaatatcggcaggaataagattaaatggaaaaggaaaacgatcttgtatttcagcgaaccaattttgtccattccatttttctaatcctgattcaaaaaactcccatgcgagaaaaaagcgtaaaatcaataaacttacgccactgccgataccttgcatcttacaatccttcatttttttacctttcaaattttctcgcttttaaagcgaaaagtgtattgagttacttatcttaccacactaggaaatattacccagttgcttacttagtcgaagataaaccttttttcttacaaatttttttgaaaaattttaactatcaacaaaaatcgggtaatatgcgcacgaatttttaaccccttaatttggagtaaatcacttatggcaatgaataatattctcggattatttgcccattcgcctctcaaaccgttacaaaaacactctgaaaaagtgaccgaatgtagcgatcttttgattcctttttttcaaactactttctcaaagaattgggaacaagcggaagaaaaacgcttagaaatttctcaatgtgaacgcgaagcagatagtttaaaacgtgaaattcgattgaaattgccacgtggtttattcttacctatcgatcgtactgatcttttagaattagtcacgcaacaagataaacttgccaattatgccaaagatattgcaggccgtatgattggtcgtcaatttggtattcctgaagaaatgcaagaagaattcttacattacgtaaaacgaagtttagatgctattcatcaagctcaccgagtaatagaagaaatggataagctattagaaacgggttttaaaggtcgtgaactcaaattagtcaatgatatgattcaagaacttgattcaattgaagatgatacagaccaaatgcagatcaaattgcgtaaaatgctttacaccatcgaaagtcgttataatccaattgatgtaatgttcttatataaaattattgaatgggttggcgttttggctgaccaagcacaacgtgtcggttcgcgcattgaattaatgctcgcgcgttcataatcaacaaaacataggaaataaactatggaaattattagtcaatatggttcttggttggtgtggatcacagcagtctttggcttttttatggcgttcggaattggagcgaatgatgtctcaaattcaatgggaacatcagtaggatctggtaccataaccgccaaacaagcgattattatcgcattaatttttgaatctgctggtgcctatctagcaggtggtgaagtaacacaaaccattaaaagtggtgtaatcgaaccaatacaatttgtcgatacgccagatattttagctctaggtatgctttcaaccttatttgcatcgggtgcttggttatttattgcaaccaaaatgggttggccagtttctggtacacacactattattggtgcaattattggatttgcctgtattacgattggccctagttctgtagattggtcaaagattggcagcatcgttggtagctggtttgtcacgcctgtcattgcgggtattttggcttatgcaatctttgcaagtacgcaaaaacttatttttgataccgaacaaccactaaaaaatgcacaaaaatatggcccttattatatggggataaccgtgtttgtactttgtatcgtgacgatgaaaaaaggcttaaaacacgtaggcttaaatctttcaaacagtgaaactttaatcatttcacttgccatcagtcttatcggaatgtttttcttccatttctattttaaaagcaaaatcttcactcaatcagcaaacaaaggcacttttggtgcagtagaaaaagtcttcagtattttaatgttattaaccgcttgtgcgatggcatttgcgcacggttctaatgacgtagccaatgcaattggccctctttctgcagtggtctctattgtaaatgaaggcggtaaaattgtttcaggtggagccttaacttggtggattttacccttaggtgcattaggtattgctgtgggcttaattactatgggacaaaaagtgatggcgactgttggatctgggatcaccgatttaacgccaagccgtggctttgccgctcaatttgctactgcgatgaccgttgtcgtggcatcaggcacaggcttacccatctcaacaacacaaacacttgttggagctattttaggtatcggctttgcacgtggtatcgcagcactgaatttaacggttatccgaaacatcattagttcttggattgtcacattaccagcaggtgcatttttcgccattattattttctatgtgctaagaacaatctttaattaattgatctcaataaaaagtgcggttaattttaaccgcacttttgttgtgatgtttaaggggaaaaaatgaaaaagatctataaagccttaatctcatctttacttttaagcacatcaataaatgttgcttatgcggaaacccaatatgttactgaaaatttaagtactttcttacgtcgtggtgcaggcgaacaatttaaaattgcaggttcaattcaagcaggcgaagcggtgaatgtattagatcgccaaggcaaatacacactcattcgcgacaataaaaatcgtgaagcttggattttaaattcagacttaagcagtacgccaagtagtaaagaagaaaatccaaaattaaaagcgcaagtacaagaattaaccttaaaacttagtcgtttagatggcgattggcagcaacgtaccgtagaaatgcaacgtcgaaccaaacaagctgagcaacaaagtgcggttcttttagagcaaaattcacaattgaaacgtgaacttgaaatgaccaaaaataaaaatcgtgatttagaagcgatacttgatgcaggtaaacgagaaattgcgatccaatggtttatttatggcggttcagtattgggcgtaggcttactcttcggcttgctcattccttatgtgttaccaaaacgtcgccgtcgtgatggctgggcataatcacgaatgaaagtttatttggttggaggggctgttcgtgatcaattattggggttacccgtaaaagatcgtgattggattgtggtaggcgcagaccccgctacgctactctctctcggttatcagcaagtaggcaaagattttccagtttttctcaatcctaaaacaaaagaagaatatgcgcttgcccgaacagaacgtaaatctagcgcaggttacacgggctttatttgtgatttctccccaacaatcacattagaacaagatttaattcgacgagatctcactattaacgccatggctcaaagcgaagacggtgaaattatcgawccttatggtggaaaacaagatttagaaaatcgaattttgcgccatatttctcccgctttttcagaagatcctttacgagtattgcgcgtggcacgctttgctgcccgttatcattccctcggttttaaaatcgcctcggaaacattagctctaatggcagnacttgcccaatcaggagaattacaacatctcacggcggaacgcatttggctagaaacagaaaaagccttaaacgaaaaaaatcctgaaatttattttgaaaccttacataaaacaggcgcattaagcgttttattttctgaaatcgatgccctttatggcgtaccaaatccagtaaaacatcatcccgaagtggatagttttattcataccatgttggtattaaaacaagcggttaatttgactgaaaataaccctatcctaaataaaagtgcggttcgttttgccgcaatttgtcacgatcttggcaaggctcttacacctcaaaatattcttcctcatcattatgggcatgaacaagctggcataaaaccgactagatcattgtgcaaacgcttgaaggttccaagttattttcaagaacttgcagaactgacttgtgaatttcacacgcatattcacaaagcctttgagcttcgagctgaaaccgtcataacgctgtttaatcgttttgatgtgtggagaaaaccacaacgctttcaagaatttctacaagtatgtctcgctgatactcgaggtagaacaggttttgaaactaaagactatccacaaatagattacatcaatcaattattacatgcggcaaatgaagtagatgtacagcaagttattgccgatggatttgagaaacaagcaatcaaaaatgaattgacgaaacgaagaatcttagcggttaaacaaacaaaaacgaattacccaacaaattaacaaataaaagtaactttactcaattaaactaaatccttaaaatatgcgagcttattaacttgatgaataatatgaaaacctttaaatttttcaccgcacttttkgccactgcgattctaaccgcttgcacattagatatggaacgtcctactaatgtacaatacattgataaaacggatgcgatatggcaacaacatttacaaaagattcaaaaaattcaatcctatcaagccaaaggacaaattggttatatcagtccaacagaacgtttttctagccgctttgaatggcaatatcaaaatcctaaatcttatacgcttaaactctattctttaatcagtaaatcgactctttggattcaaatgcatcaaagtgggatgacaatttccgataacaacggcaatcaacaatctgcagccaactccaaactattattacaagagattattggcatggntgtgccattagaacatttagcttattggttgaaaggccaaccagcaatgaacgcggattatcaagttggcaccaaccatttacttggcgcatttacttatcatgtggatggttctcaatggacggcagattatctaacctatcactcaaataattcgatgcctgaaaatattttgctgaaaaatgacagcacaaaacaaaccttaaaaattcgcgtagacgagtggatttactaatgaatacattaatgaaatcacatcaattttctaccgcactttgccaaaatacaacagaatcaaatgggcagccattacgcttccctagcccagccaaactgaatttatttctttatatcaatggaaaatttccgaacggctatcatgaattacaaacgcttttccaatttttagattttggcgattggttagacattagtattcgggaacaagataatcaaattgttttaacgccagaaattccaaatctaaaaacggaaaataatctaatttatcgagccgcaaaacttttacaagaaaaagccaatattcaattgggtgcaaatattcatttagataaaattcttccaatgggaggcggtgttggtggtggttcatccaatgcagcaaccgcattagtctctttaaattatttatggcaagccaatttatccattgatgaactagcaaaattgggattaacattaggcgcagatgtgccaatatttgtacatggacacgcagcttttgctgaaggcgtcggggaaaaaatcacttattgtgaacctgccgaaaaatggtttgttatattaaaacccgatgattcaatatcgacggctgtgatatttcaagatccaaatttaccacgtaatacaccgaaaaaatccctcgcacaacttttgagtgaaccttataaaaacgattgcgaaaaagttgtgataaatcattattcaaacgttgaaaaagcgttaaactggttgctacaatatgcgccggcaagattaacaggaacgggagcctgtgtttttgctgaatttgatcatgaagcagaagcgcaagsggtatttagacaaaaaccagaagcattttttggtttcgtcgctaaaggactcaatgtgtctcccttgcacgcaatgttgaagcagctatcatcaactcatactcatagacaatctaaacctgaggttttataaaatgcctgacattaaactcttcgcgggtaatgctacacctgaacttgcaaaacgtatttctgaacgtttatatatttcactaggcgatgcaacagtcgctcgtttcagcgatggagaaattcaagttcaaattaatgaaaatgtgcgtggtgcggatgtatttatcatccaatcaacttgtgcgcsaaccaatgataacttgatggaattggttgtgatggtagatgcgttacgtcgcgcatctsctggtcgtattactgccgtgattccttatttcggctatgctcgccaagatcgtcgtgttcgttctgctcgtgtgcctattaccgctaaagttgtggcagatttactttcaattgttggtattgaccgtgtcttaacctgtgacctacacgcagaacaaatccaaggtttctttgatgttcccgtagacaacgtatttggttcgccagttttaattcacgatattttgaaaaaatctgatcttaaaaatccaattgttgtttccccagatattggcggcgttgtacgtgctcgcgctgtcgctaaattattaaatgatacggatatggctattattgacaaacgtcgtccacgtgcaaacgtagcacaagtgatgcatattatcggtgatgttgcagatcgtgattgtattttggttgatgatatgattgatactggcggtacgytttgtaaagcggcagaagcattaaaagaacgtggtgcaaaacgtgtttttgcttatgcaactcacgccgttttctctggtgcagcagccaaaaatttagccagcgatgccattgatgaagttgtagttactgacacgattcctctatcagaagaaatgaaagcgatcggtaaagttcgcgtgcttacgctttcttccatgctggcagaagctattcgccgcattagcaacgaagaatctatttctgcgatgtttaactaaattaaaatttcaataaaaaataccgcacttttattgccaaagtgcggtatttttttatttactttatttaactgtatctactttattcaaccgtacacgcgcaaattttcgtttacccacttggtaaacatttgtacctttcggtgcattgtcttttacgttatcgactttttcaccattgatttttacaccgccttgttgagcagagcgaatcgcttcagaagtggaaggaacaagacctgcttcttttaataaggtggctaaacccatttcgccagagaacgtaaattcaggcatttcatcaggcattgcgcctttttggaaacggttaataaattcttgttctgcagcgtttgctgcctcttcattgtggaaacgtgcaattaattcttttgctagtaagattttgacatcacgaggatttttgccgttttctacttccgattttaattgtgcaatttcgtttaatggacggaatgaaagaaggttataccaatcccacatgagttcatcagaaattgacatcactttaccgaacatatcgcttggtgcttccgttacgccaatatagttaccaagtgatttagacatttttttctcgccatctaagccaacgagtaatgggagtgtaatcgcaacctgtggttttttgcctgctgatttttgtaattcacgaccaacaagtaagttgaatttttggtctgtaccgcctagttccacatctgcgtctaatgcaacggaatcgtagccttgtagtaatggataaataaattcatggatggcaatgggttggttgtttccaaagcgtkttttgaagtcgtcgcgttcaagcatacgcgcaaccgyatagttgcttgcaaggcgaatcatacctyctgtaccaagtttgcttaaccattcagagttgaagacgattttggttttttgtggatcgagaattttataaatttgctctttataggtttccgcattgcgcaatacatcttcacggctaagtggaggacgagtcgcatttttgcccgatggatcgcccaccattccagtaaaatcgccaattaagaaatagacttcatgaccgagttgttgaaattgacgtaatttgtttaatacaacagtatgtcctaaatgaatatctggtgcggttggntctgcgcctaattttacttttaatgggcgattttctttcagtttttcgattaaatccgcttctgaaaggatttcatcagtaccacgctttagttccgcgagaacggtattaatgtcagtcattattattncctaaattatgttttaaaaggttttattatagggattcttagcaatttgtgaataaaaaaaaacgcctatctgtggggaaataggcgggaatgttggagtgattatctaatattgttgttggaatgattagatgataattgttatcaatagccttgtcaatagttaaatgaaaataattcctcaaaaaaataattnattttatataagacaccgattctgtcaaagaaagtgcggtaggaatttcattagaaatttcaaattgtcccgcataagcataggcttcaacaccttgttccattgcttcttttaataagcgatcatattcaggancgatatattccgcaattttgaaacgatcaaacccattatgtaacccagcaaatagtaccactgctcgatgaccttgttttttcattgccaataactctcgaacatgtttttgcccccttgtagtaaccgcatcgggggacatacctaaattgccttttacaagcgtgattgatttcacttctacataacaatcaagcaagccttcgccttttagtaagaaatcaattcggctattttcctcgccgtatttcacttcagggtaaatttcatcatacattgccaattctttgatttgcttattttgcaatgcttcaaagacaagctgattagaacgatgcgtattgatacagcaaagctgtccatttgcgagttgagtgagttcccaagaatggggatatttacgagtttgactatcagaatgtgaataccaaattttatcgcctttttcaccgcatccagtcatcgcacctgtattggcacaatgaattgtcataacatcaccagttggcaattcaatatccgcaagaaatcgtttgtaacgacgaattaatgtcgccgattgtaaagctggaagttgcataaagttccttatttaagtttttctaaacgttgtaaaatagcgttgtcgttcatagcttgcatttttttcattctcaaagaaagtaagaatgccgcaaaagtgagcgagaccacaaaggcaatccagaaacctttcgcatcaatgtgtggcacaagccaatctgtacgacctagcgtataaccaagtggcacaccaattacccaataagagaaaagggtaatgtataaaatgactttagtatctttataaccacgtaaaataccaccaaccaccatttgaatggtatctgaaaattgataaagtgcggcaaataataatagatttgctgccatggcgatgacaatttcatctgtcacgaagatcgatgcaatttcataacggaaaaaaatcgtaattaatgcagtaacaattgtcacagttagccctaataataatgcggcatagccaattttcttcgcattttgtggagaacctgcacccaatgcttgtccaactaaaatcgtcgttgccataccaatcgacatagggaacataaaaataaaagaactagtattcagcgtaatttgatggcttgccacaatagttgcacccagcggagaaagcattaaggacgtaagtgcatataacgccacttcgcaacaaattgcaatggcaatgggtaatcctaaacgcagtaattttttaagtgttttcggatttggcatttcaattaattgactaaatacttttagtgaacgttcttgagtattcgtgtaggaatagaaaatcatcattaagcacattgcccagttcacaatagctgtcgcaataccacagcccaccgcaccaaaagcaggcataccaaattttccataaataaaaatgtaattaagcggaatattaatcaataaacctaaaaaggtaatgaccatcgcaggcttggttttctcaatcccatcatttaaacaacgaaaattaatcagcatcaaataagctggcaatccccacaacatcgcgtgtaaataatcgcgtgctaaatctgacattttgctttccatttgcatatattgcagcggaatttcacagaaataaatcagtaaacctaaaggaatactcacgcctaacacaagccaaatgccttggcgaacttgatgtgcaatgcgatggtgttggcctgaaccattcaaataagaaattgtaggcggcaatgccaacaataaaccttgcccaaaaaacatcaatggcatccaaattgaagcaccaatagaaatggctgccatatcagtggaactcactcgccccgccataatggtatccgctaatcccattgagttttgtgcgatttgtgctaataaaataggcaaggaaattttaatcaactttttaatatcagcgtggtattgagataaaagacgaaaattcataaatttgatatactgctaaaaatttttagaaaaggaaaaaattatgtttactggaattgtacaaggcaccgcccccatccactccattaaagaaaaggctaattttagaacacaagtggtaaaattactacctgaaatgcgtaaagatctggaaattggcgcatcaatagcaaataacggcgtatgtttaactgtaactgaaatcaatggtgatctggttagctttgatctgatgcaagaaactttaaaaattacaaatctcggcacagtaaaagtgggcgattatgtgaatatagaacgtgctatgcaaatgggaacggaaattggcggacatttattatctggtcatatttattgcaccgcaaaaatttcagatattatcgctagtgaaaataaccgacaaatttggtttgaactgccaagtgcggatgtgatgaaatatattttaacgaaaggatttgttgcggtagatggcattagcctcactattggcgaagtaagagacactcaattctgtgtaaatttaatccctgaaactttacaacgaaccttaatggggcggcgtaaagtgggcgatattgtgaatatcgaaattgatccacaaacgcaagctattgtagatacggtagaaaattatttgcagtcaaaaaatttctagttcatttaaaaatattaagcaattgaataaagtgagaatgggcataaagcctattctcacatcatcaagtgttactgcaacgctttctcaattttttcaaataaatcttttgaaagattttctacaacgcttaggcgttctaaagcacgtttcatcagcgtttggcgttgggcatcaaagcgagaaaaacgaattaatggctcgattaaacgcgcagccacttgcggattactttcatttaaacggattaacacatccgttaagaaacgatagcctgatccacttacattatggaatgcttttaagttgtgatttgcaaagctacctactaatgaacgtaaacggtttggattattaaaattaaaacttgggtgatccattaataactgaataatttccaacacattatcatctgggcgagtggcttgtaatgcaaaccatttatccatgactaatccatcgtgttgccatttttgttcaaaatcagctaataacacatctctgcaaagtaatgcagctttagttgcaacacttaatgccgccaatgtatctgtcatattattcgcattattgtagtgtttttgcactaggttattgcccaaattggtgtaagccaaataagttaaacaaagattacgcattacacgtaaggcgatgtcttgttgcgtaacttgataatcattaagacgaatatgggtataaacacgcaagaaatcatcttttaaagattctgcaatttgagcttgcataaatgctcttgcggctgaaataccatcaggatcgatggttttaaaactttctgcaaactccatttctttcggcagtgtgagaattaaggttgccaattcaatatctttctcataatggttcagracataagaaagtgcggtcaaaatttcaggcgaaatttctaaagcctcgccttgttggaaacgcacaacattacgacgcaattcttgcgcaaataacatttgagccgcatcccaacggataaattgattatctgcaaatttaagcaagcctaataactgctccgttttataatcataatccagttttactggcgcagaaaaatcacatagcaatgcgggaattgggcgaccataaatgccatgaaactcaaagacttggtctttttcagtgacatttaatacatcactcaacaattcgccattatgttgtagcatttgtttcgtgccgttcgcatcataaagcgccacttttaatggaatatgtaaattcactttttccatttgatctgcggttggcggtgtggattgtgaaaccgttaaacgataagtatgcgttttttcgtcataagcatcactaatcaataattctggggtacccgattggctataccaacggcggaattgatttaaatcgaggttatttgcacgttccatcgcagaaacaaagtcttcacaggttgccgctttgccatcgttttcagcaatataaagttgcatgcctttttggaaaccttgttcacctaataaggtgtgcaacatacgaatgacttctgcccctttttcatatactgtcaccgtgtaaaagttattcatttcaatcactttttcagggcgaattgggtgcgacattgggcttgcatcttcggcaaattgcacggtgcgtaaaaatttcacattattaatgcgattcacggcacgcgaacctgtatctgaagaaaattcttgatcacggaaaaccgttaaaccctctttcaaacttaattggaaccaatctcggcaggttacacggtttcctgtccagttatgaaaatattcgtgagcaatcacactttcaatggcaagataatcatcatcggttgccgtttgtggatttgccaacacaaatttggaattaaagatatttaaccctttattttccattgcgcccatattgaagaaatcgacggcaacgatcatataaatatctaggtcatattctaaattaaagcgatcttcatcccatttcatcgcttttttcagactttccattgcccaagttgcacggttaagattaccgcgatccacataaagctctaaagccacttcacgaccacttttagtaataaatttatcttgtaataaatcaaaatctcccgccactaaagcaaataaatagcttggttttgggaaaggatcattccattccacccaatggcgaccatcttctaattcgccacttgcaatgcgattaccattcgacagtaagaatggatatttggttttatctgccgtaattttggttatataacgcgccagcacatcaggacgatcaagcatataagtgatttgacggaaaccttccgcctcacattgcgtacaaataccctcgccagactgatatagcccttgtaatgacgtattttcggctggcacaaggaacgtcacaatttcaatctcaaattcatccgcacttttgtcttttaaatcgagcgttaaactctcgccatcttgttgataatcagaaaatggctcgccattaaatttaatagaagaaaactggaagctatgcccgtctaaacataaagaagtcgcttcattatttaagcgttggaattttgtgattgcggttaccacagtatgtttaggatcaagttgaaaatctaaataaatatctgtgaccgtaaaatctggttgtttgtaatcttttctatattttgctttggctaacataatttgacctattcttataaaaattgtgcttaggataaaattttatccttaaagttgcaatggtattttcctataaaagccatttagcaaacgtttgcctgatatatgtaagatgtgctattctacgccacgtttttaattagaaaattgagaaaatagcatgtcaaaaactgcacaaattgccgttgtaatgggttccaaaagcgattgggctactatgcaagaggcaactcagattttagatgaattaaacgtgccttatcatgtggaagtcgtctcggctcatcgtacgcctgataaactttttgaatttgcctgaaaatgcacaaaaaaatggctataaagtaattattgctggtgcagggggggcggcacatttacccggtatgatcgcagcgaaaacacttgtgccagtgctgggggtgccagtaaaaagttctatgttaagtggtgtggatagcctttattcaattgtgcaaatgccaaaagggattcctgtcggaacattagcgattggccctgcgggtgcggcaaatgctgggttgttagcagcccaaattctagcaggttgggatgatgcgttattcactcgcctacaagcattccgcgaaaatcaaaccaatatggtattggacaatcctgatccacgcacataaaaacatctttagatctgaccgcacttttaaagtgcggttgtttttttcgtaaatttaacgagaaatattatgcaaaactccaccttatacccaacggtttatgtactcggcaacggacaactcggcagaatgttacgttacgctggtgcacctttagatatttatgttgaacccttagccttcaatgcaccagtttttgacttacctgaaaatgcgatcatcacggcggaaattgaacgctgggaaaaaacgcctttgactgaattactcggcaatcataaaaacttcgtcaatcaacatatatttggattattggcagatcgttttactcaaaaatccttacttgatgaactgaatctttctacctcgccttggtgtttattaaaagataaaaatcaatggaatgatcttttccaaactgttggcgagaaagtcgtcgttaaacgtagaacaggtggatatgatggacgaggtcaatggattatcagagatgaaaatagagcggacatcaccgatgatttatttggtgaagtgatcgcagaaaaatttattcctttcgattatgaagtatctattgtaggcgcaaggtttaaaaatggcgaaaagcgtttttatcccgttacacataacctgcaacaaaacggtattttgcgttacagtgtggttgattgtgcttttcctcaacaatccgtacaacaaaagcaagcagaaacaatgctcggcaaaattatggataaattaggctatgtgggtgtgatggcaatggaatgttttgttgtaggcgacaaattactgattaacgaacttgcgcctcgtgtacataacagtggacattggacacaactaggatgctcgattagccaatttgaattacatttacgtgcgctactcaatttgccaacgcctgaattacaaacattcgccccaagtgtaatgattaatttaatcggcaccaatcataaccctaagtggcttaacataccttttgcacaacttcattggtacggtaaagaagtgagaattggacgtaaagttgggcatatcaatctttcccatcctaataaagcggtcattattcaacaattagaaaagctttgcactgaattaccagaagattatcaatcaggattaaattgggcgattgaaaaactaaaataatgtaaaaaatgaccgcactttttgatgaatatttaaaaatatcaaagcgtggttaatttttataaaatctttcttgataaaataaaatgactgaagtataaaactattcatcacacaacacatacataaggaaaagctatgtttgaacatatcaaagcggcaccagccgatccaatcttaggcttaggcgaagcatttaaatccgaaactcgcgaaaataaaatcaatttgggtattggcgtttataaagatgcgcaaggcacaaccccaattatgcacgcggtaaaagaagccgaaaaacgattatttgataaggaaaaaaccaagaattatctgactatcgatggtattgcggattataacgaacaaacaaaagcactccttttcggtaaagattctgaagtcatccaatctaatcgagcaagaacagtacaaagtttaggcggaacaggtgcattacgcattgcggcagaatttattaaacgccaaactaaagcacaaaatgtttggwtcagcacaccaacttggccaaaccacaatgcgattttcaatgctgtcggtatgaccattcgtgaatatcgttattatgatgctgaacgcaaagcccttgattgggaacacttattagaagatttaagccaagcaagcgaaggcgatgtggtgcttttacacggttgttgccataatccgactggtattgaccctactccagaacaatggcaagaattagccgcactttcagctaaaaatggttggttgccactctttgactttgcttatcaaggtttagccaacggattagatgaagatgcttatggtttacgtgcttttgcagcaaaccacaaagaattattagtggcgagttcattctcgaaaaactttggtttatataatgaacgtgttggtgcatttacccttgtggcagaaaatgcagaaattgcatcaacctcattaacccaagtaaaatcaattattcgcaccctatactctaacccagcttctcacggcggggcgaccgtagcaacagtattaaatgatgctcaacttcgccaagaatgggaaaatgaattaactgaaatgcgtgaacgcatcaaaaaaatgcgtcacttattcgttcagttattaaaagaatatggtgcagaacaagatttcagctttatcattgaacaaaacggtatgttttctttcagtggattaacaggggaacaagtggatcgtttaaaaaatgaatttgccatttacgctgttcgttctggtcgtatcaacgtagctggaatcacagaagataatattcgctatctatgtgaaagtatcgtgaaagtactttaattagagttagaaatcatctctaacctaaaatagagcaaatataaatagttaaagccttgattatcaaggctttaattttatctaatcattaacaaattctcggcaatggttcatttgttggtaaatctaacaatcgactttgtccaaaaatgcctactaaacgcacttttttatcggttattacttcaccaatcacagccgcatttttacctaatggatatagaaatcataaactgataatttctgtggctaattcgttaataaatccatgatgatgggatgaaatcaaaatgggtaaggaaagttctcgcaaaagtgcggtcaatttttcagtattttttcgatctaatccattggtgggttcatctaataataagatttttggctgcatcgctaagacacctgcaagtgcggtaaaatttttctcaccaccagataaggtatgtaccatacgatcttttaaacgtgtgataccaagacgttctaattgctgctctgcgatatgatacgcctgctctctaggcacattttggtttaatggcccgaaggcaatatcatccaatactgttgggccaaaaagttgatcatccgcattttgaaaacaaatgccaatcgtgccacgaaatggcgcaaaatctttttctttacgacaaactttgccaaatagtttaatttcccctttggttacaggaacaaatcccaacaaagcaagcagtaaagtggtttttcctgaaccaatttccccttgtacgaaaaggcgtttttgaccttccaaggtaaaactcaaatcttgaataatcgctctaccattgcgttctatacaaagattatttacagctaacatgttatttttctctctttttgccgaactgaaaaccacgacattttaacgccatttgcgccgtttcagctttcagcagggcatgaatcaataataaagcgacactttgagcagtcacataaagagttcggcgattaagccgaggacgaaatccacgagcgcgcatggcaatatccattttttgacgcaattctccaagcagtgcaatgtaacgtacggtcagcacaaaaagttgaattaatttttctggcaaaggcaatttgccaatggcttggaacaagcaccgcatcattaatattccataaaaaaagccaaagagaaatcagcaataaatgagtccgtaaactcaatttttctgctaattctataccttgaaaattgagttcaatgccattttctccaattttccaacttaatgtcgcccacattaaaacaatgaaaatgactaaagcaaaccaacgtttaagataaggcaaaaaagatttttgactgnactgcagtgaaataaaaaagagagaaacagnaagcacattaagggggataagccaagtgagatcacttaatccactaatgattagcccccagataaacagataaatcaacctaaagtgcggttgaaataagtgatgaattttcattaagagaaattctcggtacgattcatcacttcaggatacattttaccaagcaaggtaatcacccctacgctgataatactatccaaaataaataccggaatatgagagactagcaagagccaaacaagattcagataactttttccaccatctaacatcagcacaaaagaagcaagcgcgcctgccccgccaacgccaattacgccagctccaataccaactaataagcgatcttttaatgccatttgtggctgtaaacgagaacggaaaagataatgagcgatcaccgctggcgttgccatcacacaaagattgacgcctaacacggcaaatccaccaaaagaaaagaaaatgacttgcaataaaagtgcgatgaggaatgctggaaaaacagcccacccaagaaataaaccagccatgccatttaaaattaaatgcacgctaccaattcctacaggcacatgaatggttcctgccacaaaaaatgcagcggcaaaaagtgcggtgagcggtaaacgttctgattctaaacgacgtaaccccacagcaatgcccgcaacagcaagcactgcaccagctaataaaataggcgtatgtaacacgccttcagataaatgcattaaatacgtccttgtttaattttacgcgcattacgtaaagcaataagtccagcaataccaacgatataaccgattccgcctaaaatatcatgcaaataaattttatcttttaaatgtgcaatatcttcacgaagcagcattaaatctgcaccgctttgattttctgcagatgtatgagcggcaacaacggacgcacggtgtccttcatcgccttccaccaccacttttaaggttgtgtgtggcacatcagcaatagaaagcttaaatacaccttggcggtctgtttttccagttaaaacgggatcagaaacacctgagcggaaaacttctaaataagtttcagctgctggggtcatatcagaataataggatttgccagagagtgtttgcccatcatattgggcaaacacataaagtgcgtgggcataagcattcgggagatagcaagccgcaaaaagtgcggttaaaaaagcaaattttttcatcccaaatccatattattgtgcgtcaaaagttagcatatattccacagttcgacgatcgtaatccgcattatttgttactttttcctcaaactctgcccatactttgttgaagcctttagttggcgtaaattgagcgatacctttttcattagttaaattgaacggtgcatcttcactcacacccactttaatgccttgaacgggtttaccattatgtaacacaaggatagaaagtggtttattcgcttgtgctttttcttgaggaatcaattcgtaagcttgttgatgagatttgaaagattcagcatcccatttcaaaatcgctttaccaaatttaacaggattggtactaaattctgctgttggttcttcacgttttgttttttcaacgtatttaccgcttggtaattttgaccatacaccattatcgaaatgaacgaatactaaatctgatttaggcataagataggcttcgccatttctgaattggtaatcaacggcagttaatttgccttgcgaatttaaggcttggatagatttaagtttagattctggataggtttcagtttgttcatgtccaaatttcaccacgtattcatcttgcgatgaagcaggctcaagccaaacattgtgtgcgttagcaacagacatacctaaaagtgcggttaatcccacagcgatttttttcaattccattttggatactccttgtttgtttaagaaaatctaggcgtatgataaaatatgaagtaactttagaatcaagtcattttttaaggaaattgatgaaaattggagcacttgctaaagccctaggctgtaccgtagaaaccatccgttattatgaacaacaaggtttaatcccgcccccaaaacgcacttcaggcaattttcggcaatataatgaagaacatttgcaacgtttatcatttatttgtaactgccgaaatttagatatttcattaagtgaaataaaaagcctactgaatttggaaaatgcctccaaacaacaagcagaagaaattaatcgtgtgttagataaacacattaaagaggtggcaacaaggattcacgnactcgcccatttacggatgaaattaattgaattacgtgaaaaaacagtctcgaatgatgaagatccaatgaaattgctattgcaacatagtggcgtaaaatttgtgcgattaaaataaccgcacttttagattatggctgactagataaacgctgttttgcttccttattgcctaattcagcggctttcttcagccattccaatgattttttcaggttggttttgtaagcgataaatattacttaacatcatcatcgcatctgtatctttagcttgcgctgtacgttcaaaaagcttaatggcttgctctgtattttgtttgacgtaatcgccacgtagatacataacgccaaggttatttagccctttcacactgcccttctctgccgcttcgctaaaccaccaataagccttttcatagtctctcaccgtgccacgcccaaggttatataacatacctagattgctttgagccgttatatttccttctaacgccattggatacataatattgaaaacgtcgatccattgttgtttattggcaaactcttgtgccaaattcattcttgcttgatcatccattttcggactcgctgtaacatcaacggttttcattgcccaaataggcaaactaaaacaaagtaatactatatgaaaaaataacttcagtttcatttacaaggttgctactaaaagtaaaataaaaaacacggcagtaatcgcaaattcgattagtccaacttgcataacagaaagctttttagtgggcaaataaacggctcgcactaatccaggcacaaaagctaatgctaaaataaattgttgcgaaaccacaaaaatcagcgcacataataagtgaaaaatcactgatgcccaaaaataacgtggattttttcgttcacgcatcattgattttacataaagtgttgttccaataaaaaataatgttggataaatcgccacccaaagtattttttcatcaaaagttcggtcagaaaagtaataggatcccattccagctagagcaaaaattaagatccctgccaagtcattccataaattgcgctcatcttttttcttggtgaaataaatattcaccgcaacaaacggtaacatggcaaacataaaatacaacacttgccaattataaattaacgcgggaatcgcaaaaatcactgcggcagcaaaataaatcacagaccattttttatataactcaagatttttacctttaaacaaattcaaaaaaggataagtcatcaaataaagcgaaaaccatcctaataataaaaagatgtgcgcccatacaggattcgcaagtaacatgccgtaaataaaaggcaccaatgccataacaatagcaccgtactgattagaaataagcagtttcataataattaaataattgagaataattgtcgggtattttagcctagtaaagaggattttacaaagcagtaaaggctatttagaatagaagaaaacaccccaaaggagaaccctatgacaattcaacgcattttacccagtgcacgtttaagtgaagtttcaattcataacaacctcgcctattttgcagggcaagttccagaattaaccatcgagcaaaatgcctacgaacaaaccaaagaagtattaggtttaattgataaattgttagcaaaaattggctccaataaaagcaacattttaactgcgcaaattttcttagctgatatgaaagattatgcacaattaaatcaagcttgggatgaatgggtcgatcatgttagcccaccaagtcgagcgacagtggaagctaaattagcggatcctcattggaaagttgaaattgttattattgcaacttgttagttttttaagccgaataaacaggagaatattatggaaaattggaccaatgaaatttgggtagcaattggcatcgcttttattgttggattatttattggttacattattgtgcgtttaaccaaaggatccgtaaaacatcaagctaaaacagaagctgaattaaaaacagtcaaaacccaacttgatacacaaaaggcgcaaatcgaaaaacatttcgcagaaagtgctgagttattcaaaaccttaattaacgattatcaaaaactttatcgccactacgcaacctcttccaataacttactgggcgaaaaagatcaaaaaggtttatttacccaacagttaattactgcaacagataaatctcaaaatgaacagcctagagattattcggagggtgcatcaggcttatttaaagaaaataaagaagaaaattaaaaagtayggctaaaaatagaaatatttttagccgtttattattctattattgcgttgattttttagattttttccatttccaaaaaagaatagtacaagtacccaataaatatataaatcacaatttgacctttttgaatttgtgtatgtagccaatctaaatttttagcccccaattccccaagataaatccaaataggtacagaaataatcgcagcacagaaatctattaaaacaaaacgaacataacttacacggcgtgtaatacctgataccatataaattggagcacgtaaaccgggtaaaaatcgtgcaacaaacagtactcgattgccatattgactgaatttttcacgcaccattcttaaacgctgtaatgttacgattctacgtattggtcggaaacgtaaaattttcgtgccataaattcgaccaagccaatacatacaggaatcgccagcaagcacaccaatcatactaaccagtaacatcaaatgagaattgacattttctggataaagccccgcaatgacaccacctgaaactaatgttatatcttctggaataggtacaccaaatccacaaataattaaaacaaaaagracagcccaataaccatattcagtaaaaaatccaattaaaaattccatttgttcctgcttttttattatattaatagatgtgataaaaaattggttcacattttaatcttttcaaatcaaaaagcctagaaaaaagtttgatttgaaaataaggatattctataatccacggctctcaaggcttgtcyttgarcggtttttaggaaaattgckgggycgcctgcgatttyctttcttttaacattaatttaaagagaacattaaaatggcatttaaatttaacgctgaagttcgtacagcgcaaggtaagggtgcgagccgccgcctgcgtcacaatggtcaaattcctgcaatcgtttatggtggtagcgaagagccagtttcaatcatcttaaaccacgatgaattaaacaacgnacaagcacacgaatctttctattctgaagtgatcactttagtagtagagggtaaagaagttgcagttaaagtacaagctatgcaacgccatccattcaaaccaaaattggttcacattgacttcaaacgcgcataattctaattcacgcatttaaataaaataacaaaaaagctaagacattcatcttagcttttttcttacagattcattgtttctcaataaatatctaaacttcaattttttatcaaataacgttttaagttttcaccaacaaattctaattctgcttttccatagtttggctgaaattctaaaaaaatcaccccagcctttcgacaagcctcccgtttcactgcatcacgcttcgccgcattatcctgataatgtccctgcccttgatattcaattactattacggcatagccgttcttatctacaatcaaaaaatctactcgtttactatttatcgcaaaatgggcctctttatctattgattctaaaaactcccccattgaaacctgagtaaataaacggaactcttgataacctttagacaacaacttttctaaacgaagaaaaagttgatattcactcttattcattaaggcttttcttttatacttactcaatatgacgacatcaagatgatcatttttattcacaatattaattttgttttctgtcgaaagataaagacgactcttcttttcattacgacgagttgatctcgatttagatgaaaataagccaattagaaataaaataanaaaaatgaaaatagtgatgtattgtaaagaaaattccatattgctctcctaaatgaacaggaaaacaagntagcattaatagaatattacttcacattacaaataagcgtgtttgggatctgaatcgcaaaaacaaccttaaataaggtgaaaaactagcttttattaggactatgagaatttaaaaatatggctggggtactaggattcgaacctaggaatgctgagatcaaaacccagggccttaccgcttggcgataccccaattagataaatctttgattggatataaagaagacttttttgatagtatggctggggtactaggattcgaacctaggaatgctgagatcaaaacccagtgccttaccgcttggcgataccccamcgactatttgaattacaaagcgataaatggtgcgggacgagggacttgaacccacacacctctcggcgccagaacctaaatctggtgcgtctaccaatttcgccagtcccgcaaatttggtggctacagcgagattcgaacttgcgaccccaacattatgagtgttgtgctctaaccaactgagctatgtagccatcacttaatttgcttaaccatatcggctttgcggggcgtattatgctaattttgatgatcctcgtcaaatacttttttacaaraaaagtaattttatgtttgtttggttattaatgaagcatatcacttattttttattcatttaaacaacttatatgttatatggctttctcaacagccaaatttttcctaatcctatyttttcttttatgcgttcatttattgytaattaraatttatttgacamaaaatgcctaaatcgttatttctatacccactattctaaaaaaacacaacatctaggagtatcttatgccctatckctcagtcgccaaatttggcggaacatctgttgctaaccacgatgcgatgacagcttgtgcaaaaattgtcattgccgatcccaatacacgcgtagttgtgctttctgcatcagctggtgtaacaaatttattagtggctttagcaaatggtgtaaaagcgacagaacgtgaaaaattaattggcaatgatctgcatatcacttcaggtgtggcaaaacgtatttttgatactgttcaatcttataatgtgcgaatgattagttatggggcaagtaccaacaatgtttgtatgttagtacaaagtgaacattctgatgaaattgtacgctcgttacacaaatccttatttgantaaaatttaaacctaaagtgcggtgaaaaatcaccacactttttcttttatatcattgagattaaagccgaaaaagagtaaagtaaacggctgttcatttaactaatttaaccgaataaaaggcggaaattatgggaaaaagcgttgttatcttaggcgcacaatggggcgatgaaggtaaaggaaaaatcgttgatcttttgacggatcgcgtaaaatacgtagttcgttatcaaggcggccataacgcaggtcacacacttattatcaatggcgaaaaaaccgtattacgtttaattccatctggtatgttacatccaaacgtaacttgcttaattggtaatggcgttgtggtttcgcctgaagcattaatgaaagaaatgggcgaacttgaaagccgaggtattaaagttcgtgaacgtttattaatttcagaagcttgtcctttgattctgccttatcatgtggctatggatcacgcgcgcgaagcagcccttggcaaaaaagctataggtacaactggtcgtggtattggcccagcttatgaagataaagtagctcgtcgtggtttacgcgtaggcgatttatttaataaagaagcctttgccgaaaaactcaaaaacatccttgaatactataatttccaattggtgaactactacaaagttgaacctgtcgattatcaaaaaaccttagatgatgtaatggcaattgccgatgtaatcacaggtatggtggcagacatcactacaattcttgatactgcgcgcaaaaatggcgaacatattttatttgaaggcgcacaagggacaatgttagatatcgaccacggtacttatccgtatgtaaccagctcaaacacaacggctggtggtgttgcaacaggttctggttttggcccgcgtaatcttgattatgtacttggtatcattaaggcttactgtactcgtgtaggtggtggcccattcacgacggaattatttgatgatgtgggtgctgaaattgcgcgtaaaggtaacgaatttggtgcggtaacaggtcgtccacgtcgctgtggttggtttgatgccgtcgccattcgtcgtgcaatccaacttaactctatttctggtttctgtatgactaaattagacgtattagatggttttgatgaagtaaaaatctgtgttgcttacaaaatgccaaatggcgaaatcgttgaatatgcaccgttagcggcgaaagattgggaaggtgtagaaccgatttatgaaacattacctggttggaaagaaaatactttccgtatcaccgatgtaaataaattaccacaaaactgcattaactatattaaacgtattgaagaagtgactggcgtaccaattgatattctttcaactggccctgatcgtgtggaaacaatgattttacgtgaaccgttcgctgcttaatttcttttgattttcagaccgcactttaaaagtgcggtcnttttttatattttttactattcttcaatagaacgtaataattcattgatgcccacttttcctaaagtttttgcatccacttttttcacgatcacggcgcaatataggctatattttccacattttgatggaaggctacctgataccaccacagaaccagcaggtacacggccgtaatgaatttcgcctgtttcacgatcataaattttggttgattgaccaatgaatacgcccattgaaataacacaaccatcttcaacgataacaccctcaaccacttctgaacgcgcgccaataaaacagttatcgccaataatagttgggttagcttgtaatggttctaacacgccgccgattcctacaccacccgataaatgcacatttttaccaatttgtgcgcatgaaccaaccgtcgcccaagtatctaccatggtgccttcgccaacgtaagcaccaatgtttacataagatggcattaatacgcagtttttagaaatatatgcgcctttacgcaccgttgcagaaggcacaacacggaaaccttcttcagtaaaacgttcttcagtgtaatccgcaaattttaatgccactttgtcgtaatattttgtttctgcgccgtcaatgatttggttatcgttaatgcggaaagatagcaataccgctttttttaaccattgatgtgttacccattcgccagcaattttttcggctacacgatattttccagaatctaatccttcgatcacttcttcaattgccgcacgcgtttctgcatcaacggtttttggtgtaatttctgcacgtttttcaaatgcagcttcaataattgcttgtaaatttgacatagaacttcctatatacgttgtgaataaaacggcgttagttttaccatattttaaacgggcaagcaaaacaccgaaaaaaatcaccgcactttgtagaaacaaaactgcggtgataataaaaagttggtttgattaaaagattgaaagtgcaagccccacgacaacagacatactaaaaacaaccataatcattgcataaccaaaatcgctcattttgttctcctcataaaaaataacgcagacattctagcaagaataatacgaaaaaatcacttctttttataaaaaatttgcaataaagatgactaaattctcaacaaacctttataataggaaaaatttttagggatttaaatatatggcaacaattaaagatgtggcaaaaatggctggtgtgtccaccacaaccgtatctcacgtaattaataaaacccgtttcgttgcaaaagatacggaagaagcggtgttatccgcaattaaacaacttaattattcccctagtgctgtggcacgcagtttaaaagtcaataccaccaaatccattggtatgattgtgacaaccagtgaagcaccgtattttgccgaaataatccattctgttgaagaacattgctatcgacaaggttattctttattttgtgtaacacacaaaatggatccngaaaaagtcaaaaatcatttagaaatgttggcaaaaaaaagggtcgatggtttgcttgtaatgtgttctgaatatactcaggattcattggatttactttcatcattttccactattccaatggttgtaatggattggggcccaaatgcgaataccgatgtgattgatgatcatagttttgatggcggttatttagcaaccaaacatcttatagagtgcggycataaaaaaatcgggattatctgcggcgaactcaataaaactaccgcaagaacgcgttatgaaggctttgaaaaagcaatggaagaagctaaattaacaatcaatccgtcttgggtactagagggtgcatttgagcctgaagatggctatgaatgtatgaatcgtttactgactcaagagaaattaccaaccgccctattctgctgtaacgatgtgatggcgctcggtgcaatatcagcactaacagraaaaggcttgcgtgtgccagaggatatgtcaattatcggctatgatgatattcacgcctcacgtttctacgcgccaccattaaccaccattcatcaatcaaaactacgtttaggcagacaggcaataaatattctgttagaacgaattactcacaaagatgaaggtgttcaacaatatagtcgtatcgatataacccctgagcttatcattcgaaatccgttaaatcgattttataaacttaggnaaaatagaccgcactttttaaaaaatccctnaaaagtgcgggtcttttttagctattttttagcttttcttgattattttcaaaatttctctgaatagcatttgccctccaccctattttttngtnatanctatcgccaactgacaaattttattttttacttttaggagttcctatgacacaagagtacagtactctgcgcaataacattagtatgttagggcgttttctcggagaaaccatcaatgatgcacagggcgaggatattctcgagttaatcgaaaacattcgtaaactttctcgtaattctcgtgctggcgatgataaagcaagacaagcattgctcgatacgctcggtagtatttctaatgaaaatattattcccgtcgcacgtgctttcagtcaatttttaaacctcactaacatagcagaacaatatcaaacaatttcccgtgaacattctcttgcacaaagttcttctcaatccttaagcgaacttttcaaacgcttaaaagaacaaaatgcttcagtggaagaggtgcataaaaccgtcgaaaaattattaattgagcttgttttgaccgcacatccaacagaaacaacacgtcgttcattaattcataaacacattgaaatcaataaatgtttaagcaagctagaacatcatgatttaacggaaaaagaacgcaatattattgaacgtctattacttcgtttaatcgctgaagcatggcataccaacgaaattcgtactgtycgtccaacaccatttgatgaagccaaatggggctttgcgatgttagaaaacagtttgtggcaagcagtgccagagtttttacgccaactcaacgaaaccgcccgtgaatttttaggttacgatttgtcggtgggattaaaacctgtgcgtatttcctcttggatgggcggcgaccgtgatggaaatccatttgttaccgcacaaatcaccaaaaaagtgctttattttgcccgttggaaagcggcagatttattcttacaagacatcagcaaattagccgatgaactttcaatgatgaaatgtagcgatgaatttcgtgataaatacggcgaacatttagaaccctatcgtttcgtagtaaaaaatttacgcaatcaacttacagcaacattagcttattttgatgatcacttatctaatcgcacaccaagagtctccgaaagcgagattattttggaagataatcaactgtgggaaccactttacgattgttatcaatctttaattcaatgcggtatgcgcattattgcaaatggttcattgctgaatattttgcaccgtattagttgttttggcgtgacactttctcaaatggatattcgccaagaaagcacccgtcataccgatgccattgctgaaatcacgcgctatattggtttaggcgattactctcaatggatggaagacgataaacaagctttcttaattcgtgaattaagctctcgtcgtccattaattccgcaaaactggacgccatcgcctgaaaccaaagaaattttagatacttgtaaagtcattgctcaacaaaaacaaggtgtaatagcttgttatgttatttcgatggcgcgcagtgcantctgatgttttagccgttcatttactcttaaaagaatcaggcgtgccatatcacattcctgttgtgccattattcgaaaccttagaggatttagatgcagccgaaaaagtgatgactcaacttttcaatgtgggttggtatcgtggcgtcatcaataatcgtcaaatggtaatgattggctattcagattcggcaaaagatgcgggaatgatggctgcctcttgggcgcaataccgtgcgcaagaagccttagtaaatttaacagaaaaacttggcattgaactcactttattccacggacgtggtggcacaattggtcgtggcggtgcgccagsacatgcggcattactttctcagccacctcgttccttaaaaaatggtttacgtgtaacagaacaaggcgaaatgattcgcttcaaactgggtttacccgcagtagcagtagaaacctttgatctttacgccagcgccattttagaagcaaatcttttaccaccaccagaaccgaaaccagaatggcgcactataatggacgagctttccacgatttcttgcgatatttatcgtggtgtggtgcgtggcgataaagattttgtgccttatttccgcagtgctacgccagaacaggagctatccaaattgccgcttggctctcgccctgcaaaacgcaatccaaatggcggtgtggaaagtttacgtgcgatcccgtggatttttgcctggatgcaaaatcgcttaatgctgccagcttggttaggggctggtgcagctattcgtcaagttattgaacaaggcaaaggcgatattattcataaaatgtgcgaaaactggccgttcttttcaacgcgaatcggaatgttggaaatggtctttagtaaatcggatacttggctttcccaacaatatgatcaacgattagtgaaaaaagagctttggtatttaggcgaaaatttacgtaagcaacttgaagatgatattcaaactgtgctttcactttctcaccaaagtgaattgatgtctgatttaccttggattgcagattcaattgcattacgtaatatctacacggatccactcaatctactgcaagtggaattgcttcaccgtttccgtgaaaatccagagcaagtcaatcccgatgtggaacaagcattgatgattaccatcacaggtatcgcggctgggatgcgcaatacaggctagaaagatgaaaaaagtgcggaaaattttccgcactttttattcaaatcgatcacttaataaaaattgtaaaaccgcatccattctcaaatgaggaatactctccccttgttctaaaggctgaggttcaaaactatcaaaatcaaagtgcggttgtttttgccaaaattctgtttttggtaatttactcggcaccgttcctggataaagtgtaatcagctgtttatcaatagaacgaaccccttgaattgctttaatttcttttccttgctgattcacgatcacttgttttgtggtacgaacagccgcaatggcggtatattctgtatcaattccttcaaattctacatggcgaccgccctcttgcacaatttggcgcattaaactcactaaattaggaatttgatcacgagtaatatgatccgccttggtcgcaacaaacattaatcgatcaatttgcggagaaaacaaacgatgaagaaaatttctgctgccataatggaaattattaaataactgatttaagcccatttgcatatctaaaaaggcttgctgactgtgatttaaaggcgttaaacaatccgccaaaataacttgacgatcaaaggtagaaaaataattttcgtaaaaacctttcacaattttattgcgataataattataacgttttgtcagcacggcaaaatagctattcgatttggctgtttttttcaaggtttgccaatgttctcccgaaagatgaattaatggaaaaaattgtaatgcaggagccccctctaaatcactcggcaatacaaatcgcccaggctgaataaattgcatgccttgcgctttgcattgatgtaaataatccgtataacttttcgctatcttggctaaaacatcttcatttgcgaccgcacttaaatccaaattctgcaacatggaaagccaattttgcgccaattctgcacgaacgccagttgtgaccttgatttgctcttgtgaccattgttgaaaatctaaatttaacaacggcaaatcgagcagccattcaccgggataatcaaaaatatccagataaagcgtgcctcgttctttcaaatggcgtagcaagccagattgacgttgaaaacgaattgctaaacgagtttcactcacgccacgagtagattgaaaccattgaggcggattttgtgacaaatcatttaaattactttcataatcaaaacgtggcacgctgagatcttgttgggatactcgtttgactgccaaaattgaaccatttctagctgcttcaaacaagggcaaattctgtgatgaatgttgattaatggagagaagttgattgattaaacttgtaataaacgctgtttttccactccgacttaaccctgttaccgccaagcgcaaagtgcggtcaaaaccacgattaataatttgattgatttccttttgaacccgattaaacattcaatatcctagccatttttactaatatgccttacaatttgacacataatttatcacaatgcatttgttatgttacgtctaaatctgagatttttatcttttctgctctgtataatccaaagtgtagaattacaggctgcgccaagtgttccaacatttttaactgaaaatggcttaacttattgcacccacgcttcaggtttttcatttaatccgcaaacggcagatgcaggaaccagtatgaatgtggtcacggaacaaatttataacaaattatttgatataaaaaatcacagtgcaacattaacaccaatgctggcgcaatcttattccatttcagctgatggtaaagaaattttattaaatttacgtcacggcgtaaaatttcaccaaaccccttggtttaccccaacacgtgattttaacgctgaagacgtagtattttcgattaatcgtgtattaggggggcataatacttatttaccaaccttagcagagacgaatgttacctatagtaatccacaatatagagtgtttcacgaacaagcaagaaaagtgcgttttccttattttgatagcattaaacttaacgaaaaaatcaaatctgtgaccgcactttcgccttatcaagtaaaaattgaattatttgcaccagattcctccatcttgtctcatcttgccagccagtatgccattattttttcacaagaatatgcctatcaattaagtgcagatgacaaccttgctcaattagatacccacccagtaggaacagggccttatcaagtaaaagattatgtatataaccaatatgttcgcttagtgcgcaatgaaaattattggaaaaaagaagccaagatagaacatattattgtggatctttctactgatcgcagcggacgtttagtcaaatttttcaataatgaatgtcaaatcgcctcttatcctgaagtaagccaaattggcttattaaaaaatgatgacaaacattattatatgcaatctactgatggtatgaatttagcctatttagcgtttaattttgataagccattaatgcgagatcacgaaatccgtgccgctatttcacaaagtttaaaccgagctcgaatcattcatagcatttaccataacacagcaactgttgctaataacattattcctgaagtatcttgggcttcaagtgtcaatacgccagaatttgagtttgattacaatcccaaaatcgccaaaaataaattagcagataaaaaccttttgttaaatttatgggtaattaatgaagaacaagtctataatcctgcaccttttaaaatagctgaaatgataaaatgggatttagctcaagcgggtgtgaaagttaaagtgcgtgccgtaactcgtccatttttaactgcgcaattacgcaatcaatcggaaaattatgatttgattctatctggttggttagctggtaatcttgatcctgatggttttatgcgtccaattttaagctgtggaacaaaaaatgaactcactaatttatctaattggtgtaatgaagaatttgatcaatttatggatcgtgccattaccacctcacatttaagttcacgcgcaaaagcctataatgaagcccaagaactcgttttacgtgaattacccattattcctattgccaatgtaaaacgaattttagtcgcaaatagtcgtgtgaaaggagtaaaaatgacgccttttggtagcttagatttttccaccttatattttattcaggagaaatactaatgttatggtcggttcttcgccatattctgtgggtggcattattattactcgtattatcgctattaggctttgtcattttattgcgcgatcctcttaatgcgaatcttgttacacaaaacatttatatcggctatttccattatttaggcaccttgttacaaggtgattttggcattacctataacggtggaaaatcattaatgaaccttantcttacggttcttcctcccacattggaactttgtttcattacattgtttttggcatttatttttggtttgccacttggcattataagtgcggtcaattctgaacaagtttttgcaaaaagtttacaaatcctatcttatgtagggctatctattccaatattttggttagcccccattttactgtatgttgccgcgctctcacattgggaaattgccgctattggacaatataatttgctttacgaaattaaatccattacgggatttcctgttattgatatgtggtttatggaagtaccttatcgtacaaaaatcgtacaaaacatattgcaacatttagccttaccaacattggtattgtgtattttgccaacaatggaaattatccgcattattcatcaacgagcagaatatattttgaatcaaaatttttctaaagtagcgacaacacggggttggtcaaaatggaaaattctccatcaatatgtattccgtaatacttttcccctgcttgttccacaagtaccacgtgtattcacattagtattaacgcaatgtatgttggtagaaacggctttaggttggcctggcattggtcgttggttaattaatgccgtaaatgaacaagattacaacagcattgccgcaggtgtaattgttattggtgtatgtattattttgattgatacattcactaaaatattcacttttatactcgatccatttaaaaagaaaggttggtatgcaaaataaagaacctgatgaattccgcgaaagcacctcaatctttcaaatttggttacgctttcgtcaaaataccatcgcactttttagcttttatttattaatcgcattaatttttaccgcactttttgctagttatcttgcaccttatgctgataatcgacaatttattgggcaagaattaatgcctccatcttgggtagatagaggaaaaattgcttttttctttggtactgatgatttaggtcgcgacatattaagtcgtttaattatgggtactcgttataccttaggttctgctttactggttgtcttttcagtggcaataataggcggcgcactaggaattattgcaggactactgaaaggtattaaagctcgttttgtcgggcatatttttgatgcttttttatcgttacctattctattaattgccgttgttatttcaacattaatggaaccaagtttatggaatgcaatgtttgctacgctattagcgattttgccttatttcattcacactatctatcgtgctattcaaaaagaattagaaaaggattatgttgtaatgctaaaacttgaaggcatttccaatcaagccttattaaaaagcactattttaccgaatattactgttatttatattcaagaagtggctcgtgcttttgtgatagccgtgttggatattagcgcgttaagttttatttctcttggtgcacaacgacctacaccagaatggggggcaatgataaaagactctttggaactactttatcttgcaccttggacagtacttttacccggtttcgctattatttttactattttattaagtattattttcagtaatggcttaactaaagccatcaatcaacatcaagaatagcctatggcacttttagacatttgtaacctcaatattgaaattcaaacctccaatggacgtatnaaaattgtagatggcgtcaatctttcccttaacgaaggggaaatcagtggattagttggcgaatcaggctcaggaaaaagcttaatcgctaaagtcatttgtaatgcaatcaaagraaattggattattactgccgatcgctttcgttttcacgatgtcgaattacttaaactcagtcccaataaacgccgaaagttagtgggtaaagaaatatccatgattttccaaaatcccttatcttgccttgatccaagtcgaaaaatagggaaacaactaatccaaaatattcctaattggacatttaaaaataaatggtggaaatggtttgggtggaaaaaaagacgtgctattgaattgttacatcgcgtaggaattaaagatcatcgtgatattatggcaagctatcctaacgaactgacagaaggcgaaggacaaaaagttatgatcgcaatggctgtcgctaatcagccacgtttattaatcgcagatgaaccaacaaatgcattagaatcaaccactgccctacaagtttttcgtttactttccagtatgaaccaaaatcagggaacaacaattttacttacgagtaacgatattaaaagtattagtgaatggtgcgatcaaatttcagtgctttattgtgggcaaaataccgaatctgccccgactgaaatattaatcgaaagtccccatcatccttatacccaagccttaattaatgcagtacccgattttactcaacctttggggtttaaaactaaattgggtacgttagaaggcaccgcgcctattttagagcaaatgccaattggctgtcgtcttggcccaagatgcccttttgcacaaaaaaaatgtatggaaaaaccaagacgattgaaaataaaacaacacgaattttcttgtcattatcctattaatttacgagaaaaaaatttcaaagaaaaaacaaccgccaccccttttatacttaattgcaaaggaaatgaataatgcccttattacaagtggaagatttaactaaaacttttaaaggtcacgccagtttatttggtcgaaatcaattcaatgcagtggataaagtgagttttacccttgaacgtaaacaaacacttgcaatcattggcaataatggctctggtaaatcaaccctagtgaaaatgatagcgggcattattccgccaacttctggtcgaattttatttaatgatcgagaattacaatatcaggatgcccaatctagagctaaacatattcgtatggttttccaagatgccaactctgcatttaatccacgtttaaatattggacaaatattagacgaaccattaagcctagcgacagattggacagaaacacaacgtaatgaaaaaatctttgagacgctctctcttgttgggctttatcctgattacacaaatctcaatattaagcatctttctattagccaaaaacagcgtgtcgctttggcacgtgcgctgattttagaacctgaaataattattatagatgatgcaattggtaatttagatgcctcggtgcgcattcaattactaaatttaacccttgatctgcagcaacgtttaggtatttcttatatttatgtagggcaagatctcggtgtaattaaacatattgcagatacgattatcgtaatggatgaaggaaaaatgattgaatatggcagccctcaaaatctttttactgatccacaaactgatgttactcgtcgcttagtcgaaagctattttggcaaaattttagatgaaaccgcttgggtaaaagacaaaaacgctcactaaggaaagaaaaaatgaacactcgtcccttttatttcggacttatatttatcgcgattatcgctgtacttgctaactatttaggaagcaccgacttttcccatcattatcatatcagtgccttaattattgccatcttactgggaatggcaatcggcaataccatttacccgcaattttcttcacaagtagaaaaaggcgtattatttgcgaaaggcacgcttcttcgtgctggcattgtgctgtatggttttcgtctcacttttggcgatattgccgatgttggcttaaatgctgtcgtcactgatgccattatgctaatttcaaccttttttcttaccgcacttttgggcattcgttatctaaaaatggataaacaattggtttatctcactggggcaggatgtagtatttgtggtgcggcagcggttatggcggcagagcctgttaccaaagcagaatctcataaagtttcagtggcgattgccgtagtggtcattttcgggacgctttctatttttacttatccatttttctacacttggtcacaacatttaattaacgctcatcaattcggtatttatgttggctctagcgtgcatgaagtggctcaagtttacgctatcgggggaaatatagatcctatcgtggcgaataccgccgtcattaccaaaatgctccgagtgatgatgcttgcaccatttttattcatgctttcttggttattaacacgtagtgatgggatatcagaaaatacatcacacaaaattacaattccttggtttgctgtactttttattggcgttgccatttttaattcttttgatttattaccaaaagaactcgtgaaattattcgttgaaatcgattctttcttattaatttcagcgatggctgcacttggcttaactacgcaagcaagcgcaatcaagaaagctggattaaaaccgcttgttttaggcgtattgatttatttatggctagtgattgggggatttttagtgaactatggaatatcaaaattaatataaattcacttaacattgaccgcacttttaaagtgcggtctttttttatgaagaatattttcagatatggttatttaaaagatgaaattacgctttatttcaaaggacgatttaataaaccatcctctaaaaataaagggccaattgggcgtttaggaatatcaaacttttgtggataaatcacatccaccaaatacaatccatcgggttttgctgttggtgcggcaagctgacgatttttctgctcaagcagccattgcatccattcaatcggctgatttccagtaccaacctcaatcaaacttcccacaatattgcgcaccatatgatgcacaaaagcgttcgcctgaatatcaacaataatatattttccgatacgagacacattcaaatgatgcacattacgccaaggcgtatgagactgacattgcgccgcacggaaagaggaaaaatcctgttcgccaagtaaacattgccctgcctgatgcattttttccgcatctaaatctaaatgacaatgggttattcctcccgctaaaatcgcagagcgtaatttattacaataaagaatatagcggtaacggcgtgctgttgcagaaaatctcgcatggaattcatcatcgacttgttttgcccaactcactgcaatgtcatcaggtaaatgagcattcgtaccaaaagcccaagccttctctggacgaaccgcattggtttcaaaatgaacaacctgacccgttccacttacgccagaatccgttctgccagcacaaaatatttcaattttttcatttgcaatgtgagaaagtgccttttctaattcttcttgtacactgcggactttttcttgtctctgccaaccataataattttgcccgttatactcaatgcctaatgcaattttcatttttwaccttttggcttaataaagtgcggttatggtagcccaagtttatttggagcgcaaatgcataaaaacactccaaaatttattcaaaaataagcgatagtttctaaaaattgcagtaataaatgtgaattttttgtgataaagatctcattctgataatctgccattagagtttacactccagattccctataattgatcaacgtattatgaaaaactaaaaggaaattatgaaaacattgagtgaatttatcgttgaacgccaagctgaatatccaaacgcaaagggggaattgagtggtattttgtcgtcaattcgtcttttagcgaaaataattcatcgagatattaacaaagcaggtttaacaaatattctcggtcaatctggtattgaaaatgtacaaggcgaaagtcaaatgaaactcgatttattcgcccataacacgatgaaagcggcattaatggcacgtgaagaagtggctggttttgcctctgaagaagaagaaagttttatcgcatttgatacagaacgtggccgtaatgcaaaatatattattttaacggatccccttgatggttcttcaaatattgatgtaaacgtatctgtaggaacaattttctctatttaccgtcgcgtatctccaattggctcacctgttaccttagaagattttatgcaaccaggtaataaacaagtcgcggctggttatattgtttatggttcatcaactatgttggtatataccactggtaatggggttaatggttttacttatgatccatcaatcggtacattctgtctttcccacgaaaatatgcaaatgccaaaagagggcaaaatttattccatcaatgaaggacaatacctcaaattcccacaaggtgtaaaaaaatatattaaatattgccaagaagaagataaagcgactcatcgcccttacgtatctcgctatattggttcacttgtagcagacttccaccgcaatttattaaaaggcggcatttatatttacccaagtgcaaccaactatccaaatggaaaactccgtttattatatgaaggcaatcctattgcatttttagcggagcaagctggtggtgtcgcaacagatggttatcgtcgaattttagatatcgaaccaaccgcacttcatgaacgtgttccactatttgttggttcagaagatatggtaaaaaaagcacaagaaatgatggaagaatttaaagaataataaaaagcatcatctgctggttttagcggcgcaacttcacgatttctatcacgaaaatcacgctcttttatctcggctaaaatctgtgcaaagttaccatttattcctttattttgcaactgtttatagcgtctttttgcacgttcttcagcacttgcatctaaaaataattttacttgtgcatttgggaataccacagtccccatatctctgccatccgcaattaatccatcatttttcgcaaaatcttgctgaagttgtaataaagctgaccgcactttttgaaagactgctacttttgacgcagcatctgccacttcttgcgtgcgaattaaacggctcacatccattcctgcaagaaaaatgtttacctcgccattttgaggaataaattgaatatctaaatgacgtgctaattctgctaaatctgtttcatttgttagatcagttttacgttgcaacgctgccaatgcagtaacgcgataaatcgccccactatccaacaatgcatagcccaacttttcagccaacgcataacaaagcgtccctttcccagcaccactaggaccatcaacagtaataatcattcccatacaaattatcctttcattctcaaaattttgcgcattatagagacaattgcccctcattaccatcctagagattattactagcttccatgttttgtatggcttatctaataaagttaatttcacaagctctaggaaagcgtaaactccctttcaagctttttcttaaatttcagaaaatctaaccacatagaaaaaggtttttaaaaacatttcaaggtttttttaataactattgtggcacttaaggacgaaattctttcagctaaagtagctcttttttctattattaaattggacaatccttctgacgttctacacttcgtttatacaaaaaactgaaattaagcacgctagacattatgccttttaatatatacacattttttcaaacttgttctaaagacttttctacattacaataaaaaacgtagctatcaatacaaataatcaaataatgaggacaaagaaatggctgaaaatcgttatgaactaaataaaaacttagcacagatgctcaaaggtggtgttatcatggatgttcaaaaccctgaacaagctcgcattgcagaagctgctggtgcagctgcagtgatggctttggaacgaattcctgcagatattcgtgctgttggaggtgtctctcgaatgagcgatcctaagatgatcaaggaaatccaaggagcagttagcattccagttatggcaaaagttagaattggacatttcgttgaggctcagattttggaagctattgaaattgactatatcgatgagagtgaagtgctttctccagctgacaaccgtttccatgtggacaagaaagaattccaagtaccttttgtatgtggtgccaaggatttgggcgaggccttgcgtcgtatcgctgaaggggcttcaatgattcgtacaaaaggagaaccaggaacaggagatatcgtccaagctgttcgccatatgcgcatgatgagtcaagaaattcgtcgcattcaaaatttacgtgaggacgagctctatgttgcggccaaagatttacaagttcctgtagaattggttcaatacgtccataagcatgggaaattgccagttgtcaacttcgcagctggaggaattgcaactccagcagatgcggccttgatgatgcaacttggcgcagagggtgtctttgttggttcaggtatttttaagtcaggagatcctataaaacgtgcgagcgctattgtcaaagctgtaactaactatcgaaatccacaaatcctagcacaaatctccgaagatttaggtgaagccatggttggtatcaatgaaaatgaaatccaaattctcatggctgagcgaggaaaataaatnaaaatcggaatattagctctacaaggtgcctttgcggaacatgcacgaatgctagaaaaattaggaattgaaagtgtcgaactgagaaatttaaaaaattttcaacaacattacagtgatttatcaggtttgattctacctggcggtgagtcaaccgccataggaaaacttttaagagagctgtatatgctggaaccgataaaacaagctatctcttctggctttcctgtctttggaacttgtgctggtttgattctgttggctaaagagattacttctcagaaagagagtcattttggaacaatggacattgtggttgagaggaatgcctatggacgccaattgggaagtttctatacagaagcagattgcaaaggggttggtaaaattcctatgacttttatcagaggacctatcatcagtagtgttggtaaaaaagtcaatattcttgcaacggtaaataataaaatcgttgcagcccaagaaaagaatatgctggtaacatcatttcatcctgaattaacaaataacttgagtttgcataaatactttatcgatatatgtaaagtagcataaaccattatctgcatatctgccctccctaggaaacaaaccatattgtagcaatgagagcagataattttcatcaaaaaaccgaacagttactagacttaaaaccgaatgcaaggcaggataaggatgaacaaaacaaaatttcttgttgtattgacgagagcaaacgccacttcgtaattgggctttccccaaaacgaaccaaaatcaacaatcctaaagacattacacaccattgagtatttacaaggtttcaatgcggactgaatcatctatgaaagcactgacggtttggatcttacgattgccaaaatattatatcaagcagcctttttcgtgctcattgccaatccacgacaaatcaatcactttacaatgtcacatttagtaaccaacaattactgtacaagtgtagactggaataagtcaaataattttgcggtaaacatcagataatttgctgaccttattttgatgagttggctctatctaagaagaggaaataataaacaagcggtcacatttgacatcttgtttgcattttagaggtttattccgcccagtattttttcctcgtcgttttaccaatacctggattaaagctattggttggwtccaactctttatagaattttctcaaggttggtttagcctcgtataaatgccctacattgtgttcggctgggtattgcgcaccacgcttgtcaagtaatttcaacatttcgtattctagttcttcataatcataacctttttttacaatgtaatcttggtgaaagacatggcacataaaatgtccgtagtaaagtttagagataattctgttatcaatttctggcggtaacacttcaaaccaatcttgatcattgcgacgtaatgcaacatctaaagcaactatttcttctacttctttttcgtgaattgcacgataacgaattgcagcacttgcaacagcgaaacgatgaagcattgctgcttgggtttcgattgcattacattcaaaatagccaccttttgagccatctgcaatgtaggattccaaatattcacgggcttcttgaatgccttttccacccattttgataattaagtgatgctcgtatttgttgcgataatcccataagctttgtggaagatgttctgggatgaatttagacacagtttgcataaatttatcgcttaaatgttgtggtaaaaagaagaattttttgccgatgcgatccacgtttgattttaaggaaaagagttttggtagccaatgtgtaccaaactttttaatgacccaaaaggtatctttgccatattttgctgcgatgtcaaatgcatcacgatggatatattcacctgaaatgggtagcacttcgaagtttactaacatgtggcgacgaatatcgctcaacacagaagtttgattggtgccgatatagaaaacagccgtctctttttcaagcggaaaggtgtctaaacgaaccgcaaagacagcaagttttcctgcacagcctgaggcttcatagtggcgagctgggtcggcattaaaacgagcaggggagccttcatcaacttgacgaacatagttgcagtagtaatggtcgtgaccatgtccgcaatcttgtcgaatatctttaacctgataacgtttttcttgtagattagttaaaatttcttcaggagtttctcctaaatcaatgcctaaatgattttttagttctaattcacctttttcattaagttgagcgtaaagtgccatttctgtataggctggtccacgttgaactaatgctccacctgagttgttacaaatcccaccaataactgatgcgccaatgcaagatgagccaataacagagtggggttcacgaccaaacggtttaagttgattttctaattcattgagtgtagagcctggtaagcaaataacttgggaagcgttattgatgagttggattccgtcaattcgcattgtattgatgacgacaatatcgcgatcataatcattgccatctggtgtagagccaccagttaaacctgtattcgccgcttggtttataacaataacatcatgttcaacgcaaacttttacaatgttccaaaactcaagtagagtggcagggcgaactacagctagggcgtttcctgttccaaatcgataaccacttcgataagcttctgttttagttggatcagtaataatataacgagagccaacaatatcggtcagtcgtgaaatgagttgttgaacagacattttattatcctcttgtaataagaattaatagcactataacagaataattcccatttggataaggatattttaggctttaatcggtgttttttttggaattgctctacatataaagaaaattctctctttatgataggttcagtgctgtatgggtatttcaatcactcaatatcagcaatgcaaaatccgttgaaacctttaaagatagagaaaaatattatttaacaaacgaaacttttactgaaatacaacctattgatatgccaaacgaacgtaatattcaaaattatcactcgacttacaacaacattcgggattggcttggttatcaaaaagctggcgaggaaaaagcaaagtcgaccatcaattaggaattgggatgaggtagtttttgaagtgaattttaagcacaataaaaaaacatcagaatttttagccgcactttctaaagtatccgctaatttacataaatgatttaaccctacctatgctgctactcttttaattttatgaacagtattttctgtttctttcatattatcttttgataattgagtaagataattagacatggtttgtttgaataaagataaattttttaaaatttttgatttaccatgcgtttcaatcaatgctaaatcaaactgttctgaaagcttattatcattcatttctataatagattctctttcatccacaaaaaatttctgcaggcaatggtgtaaatccttaattgaaatgagtttacgtaatatgccatccattccaatttcttaatgttcctgctcgctttacataacattgacggtaaaaaatcataaataccattctaatagttttctcgcaaatgttgccacttgttgtccgcagaacaataaccaactctctaagcaatttagttctttatatcctaagttttgaatcattataatgtattttgctttgcacgccttcgtcatacgtttattttttggcatatcgttagcaactactgaatgaagcaaagaacgtaatgttattaacatcaatatgctttaatctttcagcgtaactatcaaaatcattgtaatgaaggtaagatctatttatccccaattgaggatttatttaacaatgaaattatggcttataatttagtgctaagtccgaactttgagtaaattaaccaaatgatgaaacaagccgtagcaaggcttgatgaagcaaaaccgattttacattccgaccaaggttagcaatatcagatgatagattatcaacacatactcagggagaatggcattcaaagtatgtgaagggaaattgtttagataacagtagaatggaaagcttctttagatgttttaataactggaaaaaaagctccatgagcgtattcagaagaggctaaagactgagccctgtgaatgacagaactcagtccttgagctaaataagtctaactttttgaggtcagatcatttatcaataaactgatcaaaaaaaccgaacttaatgttcgcttttctttttcattacataatacgacgcgattgagtgtaggttctagcccaatatttttcatcaagggaacttattgtcacgccttgccctgtacttgcgtgcataaattggttattaccaatataaacaccaacgtgattatttttacggaagaaaactaaatcgccttttttaagttctgatttattaatttttctacctaaatgacgctgttcagccgtagaacgaggcaattcaataccaaaaacttcagaaaaagtagtttgcataaatgctgaacaatcaataccacgtttagtggtaccgcccatacgatagcgagtgccaacccattcattataaacactggctagagccttatcgcccatcaaagcagaggaacggtttgttctcactttgtgaaaaatgcctgttcgattatctttttctaaattattaattaaaccagttaattgaatatcatcattttctgaaataacctgatgacttaccgttcgtggtgcattagaacaagcggttgctaatacagctaaaccaataataactaaaattcttttcaacataatttcaaataattaaaagaaataaaatttcgcagcggctatcaaaatttgaataaaattgccagtaaaaatccaattctaatggaatttttgtgatcttttacacaatgacttaatttgttccaccaacagtaatttcatcaatttttagtgctggctgtcctacgccaacaggtacactttgtccctctttaccacaaaccccgatacctaaatcaagctctgatttatctgcaaccatagaaattttttgcatcacttcaatgccactgccaattaaagttgcacccttaactggtttcgtgatttttcctttttcaattaaataagcttctgaagtagaaaatacaaatttaccagaggtaatatccacttgccctccaccaaagtgcggtgcataaatgccctgttttacagaagcaatcaaatcatcaaactgactttgtccagcaagcatataggtgttagtcattctaggcattggtaaatgggcgtaagactcacgtcgtccatttcccgtagtgctacgcccatcaaacgggcattcattttatcttgcatgtaaccttgcaaaatcccgtctttgatgagtacattgcactggcttggcacaccttcatcatcaatagttagtgaacctcgacgattttcaatcgtgccgtcatctacaattgtacataatggagaagttacttgttcgccaatcttgcctgtaaaaagtgaactttctttacggttaaaatcgccttctaaaccgtgcccaacagcctcgtgtaacagcacgcccggccaacccgcacctaatacaactggcatcaatcctgcgggtgctgcaactgcactaaggtttactaaggcttgacgaaccgcttctttagcaaaaagtactgctctaatatcgccatcaacaacttcaaagaaccaatctaaaccgaaacgcccaccagaaccacaacttcctcgttcacgttttccattttcctctactaacacagaaatagataagcgaactaaagggcgaatatctgcggctaatgtgccatccgtcgccataattaatacttcttcataaacggaactgaggcttgctgaaaccttggttacacgatgatcttctgcgcgcgctgtacgatcaaccaaatgtaatagctcaatttttttctctttagtcaaactttccaaaggattaatcgccgcataacgagcaataggatttacaacattaaaagcggatggcgaaatcaaattcccctgtttgacttgcgcgatcccctttaccgcctccgcacattgctgcaaagaagcaagattaatttgatccgcataagcaaaccccgttttctcgccagaaactgcccgcacaccaacgccacgatcaatatgaaaactgccttcttttataatgccgtcttctaatacccaactttcatcttggctaagttgaaaatacagatcggcataatcaatattgcgatgcgacataatgtcaaaaatattgagtaatgtttgagttgaaagattacttggtgtgagtaatgtatttgaaacttggtttaacatattttttccagtctaaagtaaatatcttgtgagtgcttgtatccgtttaatacaacagcacagattaaaatcggattaataaagtgcggttgattttgaggttatttttccaaatgcgctaatccaaattgatacaaagcattcttcttataaccatacaactcagcaactatagctgctgcttttttaagtggcaattcttctgcaattaactcaagtgcctttaccgcttgcggcgaaatttcatcgttattgtcagactttggtttgccttccacaatcaaaaccatctcgccttttgtacgattgggatcttctaaaagccattcgcgtaaatttttaatcgtattccccgtaatcgtttcccaagttttagtcatttcacgggctaacacaatgtatcgttcttcccctagcaccgcttgcatatcttctagtgtatctaaaatacggtgagtggattcataaaaaatcaaagtgcggtcttcttctgcgatattttctaatttatctttgcgtgctttacttttcgcaggtaaaaagccttcaaaacaaaatctatcagaagcaatccccgatgcacaaagagcggtaattgccgcacaagctcctggcaaaggcacaactcgaatgccagcttcacggcattggcgtactaaatgaaaaccagggtcactgattaatggcgtccccgcatcagaaatcaaggcaatattactcccctgcttgagcttttccaccaaaatatgcgctttttcttgttcgttatgatcgtgcaaagcaaaaaatggcttcttaatgccgtaatggctcaataaaagtccactatggcgagtatcttctgctgcaattaaatccacttgagcaaaagtctctaaagcacgttgggtaatatcttgtaaattgccaatgggcgtggcaacaatgtataaaattccggttaaatcagtcatttttgtttgcttttaagttatgagataagtaagatctgctacgactattgtctgtttatgatggagcaaagatgtctattctattacaaggcgaacgttttaaaaaacgtttaatgccaattttattgtcaatggctttagctggctgttcaaatctacttggtagcaatttcacgcaaaccttacaaaaagatgcaaatgcaagttctgaattttatataaacaaattagggcaaacacaagaacttgaagatcaacaaacctataaattgctcgcggctcgagtgttaatccgtgaaaataaggttgaacaatcggcagcgttattgagggaattaggcgaattaaatgatgcgcaaaaattagatcgtgcattaattgaagcgagaatttctgctgcaaaaaatgccaatgaagtcgcacaaaatcaattacgtgcattggatttaaataaactaagcccgtcacaaaaatctcgttattacgaaaccttagctattgttgccgaaaaccgtaaagacatgattgaagcggtaaaagcgcggatagaaatggataagaatttaacagatgtacaacgtcatcaagataatattgataaaacttgggctttattgcgttcagcgaatactggcgttattaataatgcctctgatgaaggtaatgcagctttaggcggttggctaacattaatcaaagcctacaacgattatattcgtcagcctgtacaattaagccaagccttacaaagttggaaaaatgcttatccaaatcatgcagccgcaacgttgttcccaaaagaattgcttacattgcttaatttccaacaaacgaatgtgtcacaaattggtttactcttgccattaagtggtgacggacaaattcttggcacaaccattcaatcgggttttaacgacgcgaaaggtaactcaaccattccagtgcaagtgtttgatacctcaatgaattctgtccaagatatcattgcgcaagcaaaacaagcggggattaaaaccttagttggcccattactaaaacaaaatcttgatgtgattttagcagatcctgctcaaattcaaggtatggatgtgcttgcattaaatgccacaccaaattctcgtgcgattcctcaactttgttattacggactttcgccagaagatgaagctgaatctgccgccaataaaatgtggaacgatggcgtgcgtaatccacttgtcgcaatgccgcaaaatgatttaggacaacgcgtaggcaatgcctttaatgtacgttggcaacaattagcaggtactgatgcgaatatccgttactacaatttgcctgcggatgtgacctatttcgttcaagaaaataactcaaatacaaccgcactttatgccgtagcaagtccaactgaactggcagaaatgaaaggttatttaacaaatatcgtacctaatttagcgatttatgccagttctcgagcaagcgcaagtgcgacaaacactaataccgacttcatcgcacagatgaacggtgtacagtttagtgatattccattttttaaagataccaattctccacaatatcagaagttagcaaaatccacggggggcgaatatcaattgatgcgtttatatgcaatgggtgcggatgcgtggttgctcattaatcaatttaatgaattacgccaagtgccaggctatcgcttgagtggcttaacagggattttaagtgctgataccaactgtaatgttgaacgcgatatgacttggtatcaatatcaagatggtgcaattgtaccagttgcaaactaatgttttctttaaaacgtcagcaaggggcgagctttgagcatcaagctcgtctttttttagaatcaaaaggcttaatatttattgcggctaatcaaaatttcaaatgtggtgaacttgatctaataatgaatgacaaagaaactatcgtctttgttgaagttcgccaacgaagtcattccgcctatggttctgctatagaaagcgtagattggcgaaaacaacaaaaatggttagatgccgcaaatttatggcttgcaaaacaaaatatgagcttagaagatgctaattgccgctttgatttaatcgcttttggcaaaacacctcaagatattcaatggattcctaattttctcgattaatggctttttataatgttacaaaaagtaaaagatatttatagcgaaagtattcaaattcaaattgcagcatcaagtatgctttctgaaaatattaccaacgccacccaaatggtgatgcaatgtttattaggcggtaataaggttatcgcctgtggcgtgtcgcgttcttatgctaatgcacagtttctcgtctcaaacttacttaatcgatatgatttagttagaccgagcttcccgtctgtgttattgagcttagaaagtgcggtgggttcttcacttgtttttgaacaaccgcctgaagaattgtattgtcatcaatttaatgccagtgcaaaatcgggcgcacttacttattgcttttgcacctttggggacagaaaaaatcgtgctaaatattatttctcatgctgtcagcaaagaagttaatgttattgtgctaactggctctaacaacgatgccattcaaggaattttagcagataaggatctagaaatatcaatcccagccaccaaagaaagtcgtatcttagagaaccatctttttgtgattaatgcactttgtgaattggttgatcagactttattcccaagtgcttgacaggaaaataaatcactttcaaactaatagtaatttaatctaaaaaggagttaattatgacattatccccgttaaaaaaactcgctatcctgcttggagcgactatttttctacaaggctgtgttgcagctgtgattggaggtggtgctgtagcagctaaagtagctaccgatccccgaacgacagggacacaaattgatgatgaaaccctcgaatttaaagtagaaaatgctgtagaaaaagatgcccaaattaaggctgaaggtcgtgtaaatgcagtgtcttacaatggccgagtacttttaatcggtcaagttcctaatagtgatgtaaaagacactgccacagctcttgcaaaaggtgttgaaggtgtcaatgaagtttataatgaactaactgttagcccaaaaatctcttttgcacaaatcagtaaagatagttggctcacaacgcaagtcaaatctaagatgttcgttgatggtcgagttaaagccacagatgtcaaagtgattagcgaaaatggagaagtatttttactgggtaacgtcacacaatctcaagccaatgcggcagccgacattgccagcaaaatcagcggcgtgaaaaaagtaattaaagtattcaaatacctagactaatccttcaaagtgcggtgaaaaattcaacaaatttttaccgcactttttcttatttttctaaataaaaaattttaatttttattctcacaaaaaccgtttatttttaaataagttatctattgtcaagaatcaaatcaaaaaatttattacttgcgatcttttctcaaacacattatcttgtggatcgttttcataaaaacactatatcttgtgttttaaatcctgttttaaataacaacaagaaggctcatacaatgaataaaagtttaatggttacaaagcgtgacggtacgcaagaacaaatcaatcttgataaaatccatcgtgtgattacgtgggctgctgaaggactagacaatgtttctgtttctcaagtagaacttcgttcacatattcaattttatgaaggcattcgcacttcagacatccacgaaaccattattaaagcagccgcagatttaatcagcaaagattcgccagattatcaatatttagctgctcgtttagcgattttccatttacgtaaaaaagcctatggtcatttcgatccccctcgtttatacgatcacgtcaaaaaactagtacgtatggaaaaatatgatcaagcgttattagatgattatactcgtgaagaatgggacacaatggacggcttcatcgatcattggcgtgatatgacgttttcttatgcagcagtgaagcaattggagggtaaatatttagtacaaaaccgtgtgacgggagaaatctacgagtctgcacaattcttatatttgctggtttccgcaagtctattctctaaatatccaaaagaaacacgtttggattatgtaaaacgtttctacgatgccacatcgactttcaaaatttccttacctacaccaattatggcgggcgtgcgtacaccaactcgtcagttcagctcttgcgtattaattgaatgtgatgacagtttagattctatcaatgcaacagcatcagctattgtaaaatatgtttcacaacgtgcagggattggtattaatgcaggggctattcgtgcattaggtagcgaaattcgtggtggagaagcattccatacaggttgtattccattctataaatatttccaaactgcagttaaatcttgctcacaaggtggcgttcgtggcggtgcagcaacactttattacccaatttggcacttagaagcagaaaacttgctcgtattaaaaaataaccgtggtgtagaagacaaccgtgttcgtcatatggattatggcgtgcaattaaacaaattaatgtatcaacgcttaattaaaggcagcgagattactttatttagtccatcagatgtacctggactttatgaagcattctttgcggatcaagacaaatttgaagaactttacgtaaaatacgaacaagatccaactatccgtaagcgtactgttaaagcagttgaaatcttttctttattaatgcaagaacgggcatcaacgggtcgaatttacattcaaaacgtggatcactgtaatacccactctccgtttgatccacaagttgcaccagttcgtcaatctaacttatgcttagaaattgcattaccaactaaaccgcttcagcacattaacgatgaaaatggggaaattgcactttgtacactttccgcctttaacttaggtaaaattgaaaacttagatgaattagaagaacttgcggatcttgctgttcgttctcttgatgccttattagactatcaagattatcctgttgtggcagcaaaacgtagctcacttgcacgccgttcactcggtattggggtcattaactatgcgtattaccttgcgaaaaatggtgttcgctattctgatggttcagccaacgatttaacacaccgtacttttgaagccattcaatattatttattgaaagcctctatgaacttagcaaaagagcaaggtgcgtgtgaatacttcaatgaaaccacttatgcaaaaggcattttaccgattgatacctataagaaagatttagattccttaacacaagagcctctacattatgattgggaaagtttacgtaaagatattcaagaatttggtttacgtaactcaacattaactgccttaatgccatcagaaacatcatcgcagatttccaatgcgactaatggtattgagccaccacgcggtcacgtaagtattaaagcatcaaaagatggtatcttaaaacaagttgtacctgaatatgaaaatttaatggataactatgaattactttgggatattccaagtaatgacggctacttacacttagtcggtattatgcaaaaattcgtggatcaagcgatctctgcaaacacaaactatgatccaaaacgttttgaagacggcaaagtaccaatgaaagtgttgttaaaagatttattaaccgcttacaaatacggtttaaaaaccctttactatcaaaatacccgcgacggtgccgaagatgttcaagaagatcttgatgacggctgtgctggtggtgcttgcaaaatttaaacgcccctattgtcttccccaacttatggggaagatagcacgacataacgaattaggatactttcctcagtctttgatagtttcccctgataaacagggaaagctaaataaatgataagttctatttaaaggataaataaaatggcatacaccactttttcccaaaataaaaacgatcaattaaaagaaccgatgttctttggtcaaaacgttaatgttgcgcgttacgatcaacaaaaatatgagacgtttgagaagctgattgaaaaacaactttcttttttctggcgtccagaagaagtagatgtatcgcaagaccgtatcgactacgcagcattgcctgaacacgaaaaacacatcttcatcagcaacttaaaatatcaaaccttattggattctattcaaggccgtagcccgaacgtggcattattgcctttagtgtcgattcctgaattagaaacttggattgagacgtggacattctctgaaaccatccactctcgctcttacacacatattattcgtaatattgtgaacgatccttctatcgtatttgatgacatcgtaactaacgaagaaatcatcaaacgcgcacaagatatttcatcttactacgatgatttaatccgtgatagccaactttatggcttatacggcgaaggcacttataccgtagatggcaaagaatgcgtcgtgactttacgtagtttgaaaaaacaactttatctttgcctaatgagcgtgaatgcacttgaagcaattcgtttctacgtttctttcgcttgttcatttgcttttgctgaacgtcgtttaatggaagggaatgcaaaaattattaaatttatcgcacgtgatgaagccttgcatttaacaggtacacagcatattttaaatattatggctgcaggtcaagacgatcctgaaatggcagaaattgcggaagaatgtaaacaagaagcctatgatttatttgttgcagcggcagaacaagaaaaagcttgggctgattatctatttaaagacggttctatgatcggcctcaacagagatattttagttcaatacgtagaatatattactaatatccgtatgcaagctgttggattgccactaccattccaaacacgttcaaatccaattccttggattaacgcttggttagtgtcagataacgtacaggttgcaccacaagaagtagaagtaagctcttatcttgtcggtcaaattgactcaaaagttgatacgaatgattttgacgatttttctctctaattaaaaacacataaaaaactaaccgcactttggaatattctttttaaatatttaaagtgcggttaattttttgttcattttaaaaggctttctaacacagaaagccttttatttcttagatttctaataacaatcttgttggatcttccaataattctttaatcgttaccaagaaaccaacagattcacggccgtcaattaggcgatgatcataagataaggcaagatacatcatcggacgaatcacaacttgaccattaagcgcaatcgggcgttctttaatagcgtgcattcctaaaatcgcactttgtggtggattgataattggagtggacataagagaaccgaacacgccaccatttgtaatagtaaaattgccgccagtaagatcttctactgttaatttgccatcacgacctttttcagctaatgctttaatttgtttttcgatctctgccatactgagcttatcgcaatcacgaagcactggtgtgactaatccacgtggtgttgaaactgcaatactaatatcaaaatagttatggtaaacaacatcatccccatcaatagaagcattaacttcaggataacgttttaatgcttccacaaccgctttaatataaaaagacataaatcctaaacgtactgaatgttgtttttcaaatttttcgccgtaggttttacgcagagtcattatcggctgcatatccacttcattgaaagtggtaagcatcgccgtactatttttggcttcaagtaaacgttcagcaatacgtttacgcaaacgggtcattggcacacgtttttcagaacgtgcgctataagccaccgtactaattgtattttgctcagtggcagcttcttgtttcacttgctgtgcttgtcgttttgcaatttcacgttcaatatcttcacgtgttaaacgaccacccacacccgaaccttgaatttgatctgcttgtaaatcatgttctgctaataaacgacgaattacagggctctgatccgcattatgattatgactattttcaatcgctgcattttgacgatcagatggtgtgggttcattcgttgcttttaacgtcgctgaactgacatctccttcttgagccgtagaaattttgcctagcaactgtttactcaccactgtttcgccctcagcttgaacaacttcagccagtacaccatcagaaagtgcgggaacttctagcacgactttatccgtttcaatttccacaataacctcatcacgtttcacagtatcgcccagttttttatgccaagtggcaacagttgcatctgcaactgattcaggtaggtctggaacaagaatttcgattgccattttatttttccttttcttcttttttactatatcttaattatcttggctcccctatttacagaggaaagcaaagataaaaacctttattaaattaaccgcactttaaaaactcaacgcatcttccactaactgtttttgctgtttagtgtgaagcgacatataacccacagcaggcgaagcagaagctggacgccctgcatatttgagtttaacggattctggaattgctgattcaaaattatgtttgctgcaataccaagccccttggttaagtggttcttcttggcaccatacataatccgtgacatgcgcataaggctcaagcgctttcttcacatcctcatgcgggaatggataaagctgctcaatacgaataatcgctacatctttctgattatttgcacgacgttgttcaagtaaatcgtaataaactttacctgaacacattaccacacgttttacatctttaggatcaagctcatcaatttctccgattaccgtttggaaagttccattaatcaactcgtctaaactggacactgccaatggatgacgtagtaaagattttggggaaatggcaatcaatggacggcgcattttacgtaaagactgacgacgcaacatgtgatacacctgtgcaggtgttgatggcacgcaaacttgcatattttgttctgcgcaaagttgcaaataacgttcaagacgtgcggaagaatgttcagggccttgtccctcatagccatgaggcaataacataactaaaccacacattctgccccatttttgttcgccagagctaataaattggtcgataacaatttgcgcaccattagcaaaatcgccaaattgcgcttcccaaatggttaacgtttttggatctgttgttgcgtagccatattcaaaagcaagaacagattcttcagaaagtaccgaatcccatacttcaaaacgaccttgattggcgtgtaaatgtgttaatggtacataccccgtaccatcattttgattatgcacaacggcatgacgatggaaaaaagtacctcgtcccgcatcttcgcctgataaacgaacattaacaccttcatcaagtaaggttgcataagccatggtttcagccataccccagtcgagcaatttttcgccttgatacattgctttacgatcattatagattttttctacgcgaggatgcgcacgtaaactttcaggatattcacatacacgtttagcaagggttaaaaaacgttcctgtgaaaatttgctttcataaggtgctgtccaatcataattgagatattgcaaccaatccatttttgccgtatccatttctcgccattctgatacgactcgatcgccattatctagcgcatcgcgataatcattcgccatctcggtaacttgttcttcagtcatcacaccttctgaaactaagcgatctgcataaactttacgaggtgtaggatgttttttgatgatgctatacatcattggttgagtggctaatggttcatctgcctcgttatgaccatgacggcgataagaaattaaatcgataaaaatatctcgtttgaataaattacgatattccaccgccatacgcgcagcaaatgccaccgcttcaggatcatcgccattaacatgaataatcggcgcttgaatcatttttgcaatatcggtgcaatattctgtagagcgcgtatcattaggattagatgtcgtaaaaccaatttggttattaatcacgatgcgaatagtaccgcccacactataaccacgggtatttgacatattcaatgtttcttgaacaaccccctgtcctgccacagctgaatctccgtggacagtaatagcaagcactttgctatgttccgtatcattcatacgagtttgtcgagatcgaacagaaccaatcacaacagggcttacgatttccaaatgggagggattaaatgccaacgttaagtgaactcgcttatcatctacggcgaaatcagaagaaaaaccttgatgatatttcacatcccccgtacgttcactggaatgtttacctgcaaattcatcgaataaattttcaggctttttacctaatacattcacgagcatattcaaacgcccacggtgtgccattcccattaccacatcatttaccccttgacgactagaatggcgaataatttctttcatcaanggaataaacgcatcacttccttctaaagaaaagcgtttcgccccagggaatttcgcaccaagataacgttctaaaccgtctgctgccgtaagttcacgaagaaaattgacacgttcttcagatgtaaaaagcggtttatctaacaggctttccatcttgctctggagccacattttctgctccatatcctgcacgtgcataaactccaagccaattgagccacaatatgtttctttcaacatttgagctaattcgccaagtttaatggtatcgcgtttataaacgtaatgatttatattgaaagtttcgttgagatcttgttcagtaaaaccgtgatggcgataatctaattcagggacgaaagatactttccaacgataataattgagaggatcaagattagcctctaaatggccacgaaaacgataggcattgataaattgtagaactttcaccaattttgcaccagctgcaggatctatcactgtcaccgcttcattatgattttctcgcgctaagcgacgaaaataatctcgcactggagtatggggctgttcaagtgcggtggtttttggcaaagaatcaaaggtttttcgccagctttcctccaccgactgtggatcactcaaatagctttcataaagttcttctatataagattgatttgcaccgcctaatgctgtgctggctaaccaatcatcaaacgccttgttttgctgcataattacctctttattatgatatttgaagcaatattttcgctccattttttacgcattatacataggattgcaacggaaataagcctcttatcggaaattgttacaaatttgtgatctagttcaaactctttagatttcaaacaataaaaaaccgcacttcatctcttaaacaaagtgcggttatttttacttgtattaaaatttaggatttagaatttaaaaatggattgctccgcttttcttgcccaatggttgtgtaagatccgtgtccagcgataataataatatcgtcatttaatgggagtaattttgttcgaattgaagaaatcaatgtttcataatccccgcgagggaaatcggtacgaccaattccgccttgaaataatacatcgcccgtaaacgccacttttttctcgtgttcaataaaaccgatatgtcctggtgtatgccctggtaaatgtaaaatctcgaaattaaagccatctaattttaaaatttcgccctcttgattaaaccaacgatcaggcaaaaaagcgtcaatatttggcaagccaaaacgttgtgcttgctcgggtaaactctcaaataaaaatttatctttttcattagaaccccaaatttcaacgccaaaatgttgttttaattgcatcgctgcgccaacatgatctaaatgaccatgggtaagcaaaagcactttaagatttaaatctagttcttcaatgcgttgaattaggcgttcggcttcgcacctgggtcaataattgcggcatttttttcatcatcccaaatcaaagaacaattttgttggaatgcggtaacggggataatttcgatattcatttttgctccttataatcgataaaactgttgagtattcaaaaggatttgcttttgaacagaatgtaatggcaaagactttaattcagctagtttctgcaatacagccaataattgttcagaaatgcccgcacgttcaaatccttcgtgttgccaagggctatccgtttcaatcatcaaacggtttaacgacaaatgttgagcaacatactgtgttttagagttccataaaatatcaggggttaggcttgcaaaatagggggtagagaaaaatttctgaaaagatttttcatctgtcttaaaccagtgaaaatgagcccgttgaatattatgtttctgcaataattcaagggcaatttctacatcgttatgtacaatatgcaaatttaacggtaaatcccattttttcgctatcagaataaatcgctccagtaattcaatgtaaggcacgtaatctaaattcggattttctcgtttagaataatgtggcaagcccacctcgccaatggcagaaatcgatgaatgatgttcgtcaatccattgaaataattttttttgttcttctaaactaggtaattgctgttcaggatgaaaaccggctgcaatataaagtttctttgggtaagtctgttttaaattcagcagttttttagcactgttgagattagtactcaccgcaagcatacctataatctttgaatgagcaagtgtttgctgaatattctcgtcagagagttggtctaaatgaagatggctgtcaaataacatttcttttccaatgaaaaaccgcacaaaagtgcggttaattttacatttgttttacacgcctttccaagttctcacagggcctgtatctacgtgaatgaaattactggttggataataacccacgccaccatttcgcagactttccgcagaagatttcactttaatcaaaggcacacccgcaatacgaaaatcaatggcttttcctttaatgtgataactatttttcgctacgcacgactttggcgacgacgcattgcattagtagaggctgaacgataaccacaaattacttcaatttcagcattgcgtaagcctaaattagtttggatattataaaatttctggaataaatttggatccattttatgcacttgatttgtccttttatcacgcattaaataatccaatttttttaacatcgcaggcgaaaaaccttttgctaaagaaaactcgccacttaatctttcgcccgtattaatgttgcggaaagttaaaatacgaggtttaggtgttgaaaccattgctaatacagaatttggtaaaatagatattcctaacgcaataccgcccagcgataaccattttcgtttattctgatccacataattcattatagctcccttattttattgaagatatttttttacgagatcccaattaatctcagcaagattaatctgacgatcataaccataaatatcaggtaaatttacaatatttccgttttcaatccacgcagtaacataatataaaaaaacaggattatccgagcgtatcggcgcagaagtggtttttttacttgctaatactgtattttttcgagtttctgtccaacctgcttcttttaataaaatacttgccaattgatcagatttttcaacacgcacacaaccagaacttaacgctcgatttttacgattaaacaatccgcgatttggcgtatcgtgtaaataaattgcatcagaacttggcatattaaatttataattacctaacgcactatcgccagccgcttgtcgaactcgataaggaaatttattatcaatagattcccaatcaatagaagcaggatcaacaacattgccttgattatctaaaattgaataattatgctccgtaatataatttggatcggctttcatttttggcaataaatcttcattaattaagcgaattggcgcattccaaggtggatttacaaccacattacttaatttgctatacattacaggtgtcctgcgcgaatttgtgccaacaattacccgagattctaaaattaaatcgccatcacgataatactgtaatttatagcttggaatattcacaaaaattccattatgaaaatcaggaatcacacgtaaacgctgtgcattcattgccaatttttgagtaatatttgattctttagaagtcggaataaacatcggcaatgattgaattgtttggcgatataaatgattttctcccgctaaactttgtatgaaatcaagaagttgattattttccaccgcacttaaccagcgttgaatatgatcattttcaggctgttgtgcttgatactgagcagatgaatacaaccaattagatgcttgagaacgaacattttgtgtgtaatataagtaatctaacaaaatatcacttaataacacatcataaaccaatccgccttgttgttctaccaatgccaatgtttctagtgaagttgccgacgattttgaaataccgcttgccaccattgccgcataatcacgtaacaattgacgagctgccgcattgtcagtccataacggggcatatttacgagaagcatataaacgcgcgagtaaaggcttaaattgtaacttatgatcgcctatttcgtgtgttagcgtcatattaagcaatgtttgtttttcttccgttaaacgttgctgatccgcataaatggcttcttcaagctcttttctttctgcgagtgacaaatgggaaagattaatgccgtacaatgatttagattggtcatttttgctcaaacctactaaaacacaacccgacatcatcatagataatgataaggcgaataatgataactttaaggtgcttttaaacactaccatttcctaaacctttattaaaatcaccgcacttgttgcttttctcaaacaaagtgcggtcaaaaccatttagtatttattttttactttccgtttttgcttcggataggccgtttgcttgattaattttctgatctgaattaaaaataacgaaatcagctgctattttttcagcttcttttaagaagaaatctggtgcttcgtaatctttcggcaaatcatcaatatctttcaatgctttcttaccctcacgtttaaaacgttcgttcaaatcttttaaacgtcttgcatcatctttatcattctctgctttacgcattttataattcaatgatagaaattttcgatctcggcgttcatttcgcactttcaattcttcattcaatgcaacaaattcaggatctttagcaatacgagcaagatgtttttcatttagaatatttactgcattatcaatataattgatatttcctacttccatataactcgctgatgggattttatcccaagcaagcgcattatcttctttatcttccccatattctttcgcatctataatttcaggaaaattaatatcggctgcaacaccttttaattgggttgaaccaccattaacgcgataaaatttttgaatagtatattgcaaaacacccaacggactctgatctaaatcatagataaaatttaacgaacgactctgttgcaccgtacctttaccaaaagtattttgcccgatgataatacctcgacgataatcttgcattgctgcagcaaaaatttctgatgcggaagcactgtaacgattaatcatcacaaataataaccccttatattgttgcgtagcatcatcatcttcatgaacacgaatacgctgataagcatcgcgaacctgcacaacagggccatcggtaataaataaaccacttaacgccaccgcttccgttaatgcaccaccgccattttcacgtaaatcaacaataagagcctcagctttttgattttctaatttaaccagtagttttttgacatcttcggttaatccaatataaaaacttggaatttttattaccgcaatgttttttcctgacactttttcaaaggttagtttagccgcttgatcttcaatacggactttatcacgaaccaaagtaataatacgtgattttccccctttagcaggctcaatttctaagcgaactttagtgccttttttccctttaattttttctaccaaatcttctaaacgccaaccaacaacgtcttcaatatcgcctgttgcttgcccaacaccaatgattttatccccaggatgcagctttttactacgttccgctggcgcaccaggtacaagagatttgatgctaatttcatcatcttctgattgtaaagtagtcccaatgccttccaaagaaagatttatactttcattaaaactttttgctgttcttggggaaagataactggtgtgaggatcaatttcacgcgcaaaagcattcaaataaatttgaacaatatcgtctgcttttgtttgcgttaaacgacgaatggctaaattatagcgttttgtaagctttgctttgatttctgaccattttttatcttttaatttaagattaataatgtcattttttacacgagcatcccaaagtttatttgcatcagcttcagtttgtgcgcagccgctttttcacgatcaatttcaatttgatcttgaccatttaaatcaggctctttatctaataaagataacgcataagtataacgttcatagcgacgtttcatcattacatcataaatgtcaaacgctgcagaaagatcgccttgattcaactgttcatctaacttagtaccatatttttgacgaagttcgtctatatcagactgcaaaaaagtattgtggttaaaatctaaatttttaatataacgatcaaaaattttctcggaaaaatcatcatctaatttaatcttacgataatgggattgagttaatcttgtcgttgcacgcttagttgccaactggctttcttcacttatcgctggaatactaatgtcacttggttttaatgtaggttgtacagcaaatgcaggaattgcactgctcaaacacaccgataaccacgtataacaaatcacattttttgacattttaaatttcataaccatttccgagtcaatttttatttattaagcaaataaacgatctgcagcaacgttcataatcaaaccgttttcaagttcaacacgtgctgaatcttttaatacttctaccactgttgcttttttagcattatctccagctttaactttcacaacagaaccaacagaaatttgtgaaaaatcaaccgcacttagtgataatttactctcttttttaaggtttttattcgcaggtttacgcggatgctttttttgttgtgcttttttagctgcagcttctgcttacgtttttccgcaaaacgcgctttcgcttcagcaagttgctgtgcagcgtgagcaacgtgttctgcatctaatacacccgcaggattaccctgtaaatcaacacgcactgcaccttcacgacagccatataaataacgccaatttgatgtgtattggcgaagagcctgacgcaattgggttttacttacgcgttcatcatcttgtaatgcttcagctaaatcttgaaataaacctatttttaatggttttgcttcgccctctaaaacaaagcaaagaggaaatttttctgctaaataagtaatgatagcttttgcgttggttaatttttgcacttccgtttgcacatctgtaacttgagatgataattgtgtgtcagtcatagttatatccttgaggcattaataaaataaagatttgcctagtttatcgcactttttacaaaattaacaacggatcccgttatgctgaataaatttcacacaaaaataacgccaagacttcacaaatacgttaaaacaacgatagaatggcacgtttttgatttataaagaaagaccacaagcgtgcctaaaacaaagctaacttcgcctccatttaaaattttaaaatgcacagaatgtgatgcttgcattaacgtgccttctattcttcaatcaaatgaacaagccgaatgcccacgttgtcatcatctattagcaagtggtacgaggtggtcattacatcgttgtgcaatgattgcattatctattttgatattaatgcccttttccttgaactaccccttattaagtttacatttattgggtattaaaattgatgcctctatttgggatggcatttggaaaatggcagtaggtggttatgaatacacagcgtttatgatctttatttgtgcagtagtaatgccgattacgtttgcacttttagtgattatgctttggctggctaagatttttcagataaaacctcgtagtgttttactatttcttggttacattaaagcttgggtaatgtttgatgtttatttagtggcactcggagtaaccatatttaaagtacgcgaatatgcaacattagaaattaatatttatttaattccttttatttttaccgcacttttaactacgctgctttttatcaaacttaatctttccgccttatggcaggaattttatcctgaatgcacttcagtttatacaaaacaagctgttgaattatgtcctgcttgccattacacattcacgcaaaaatctatccattacgatcatcaacaaaaaatttgttgtccccgctgccaatcgcctcttaatacatcggataagctaaaattacaagcaacttgggcaaccttaattgcagggattattatgctttttcctgcaaatttattacctatatctggcatttatttaacaggcgcattatctgaagatactttaatttctggggttatttcatttgttaaatcaggtagttattttgttgcttttgttgtattttttgccagtattttcgtgcctatcagcaaaatttttattatgctttacttacttgcttgcgtgcattttaaatggcaacattctattaaatggcaaatgcgtttattgcatctagtacattttgttggacgctggtctatgcttgatttatttgtattagccttaatgatgtcgcttgtcacacgcggagaaatcattaattttaccgtagggccaggcgcattttattttggtgcagccgtattttgcactatgctttccacctcacaatttgatagcaaattaatttggaaaatttatgacagagaaaaataattcctcctcaatagaagaaaaatatcaagaaagaacagcgaacttacgtaaaacaaaacgcatttcgcctttttggctattgccttttatcgcattatgtatcggggcaattttattcttccaaattgtgaaagaacgcggtactagcattacgattacctttaccaatggttcaggtatcgttgcggataaaactcaaattcgttatcaaggattacaaattggcatagtaaaagaagttcatttcactgataacctacaaaaagtggaagttgtagccaatatcaatcctgaagcatcaagtattttgcgtgaaaatacaaaattttggcttgtgcaaccaaatgtttctcttgctggcatttcaggattagattctctcgtgtcaggtaattacattactcttcaaccaggtgatggcgatcgtgaagatgaatttatagcagaagaacaaggccctattgcgcaagtttccgcaggagatttattaattcacttaatttctgatgatttaggttcgatttctattggtgcgtctgtgtattttaaaaaattacctgtaggaaaaatctatgattaccgtattaataaaaacaataaagtagaaatagatgtggtcattgataaagcctatgccaagtttgtgaaaaaagattcacgcttttggaatattagtggcattaatgcgaacattagcccatcaggcttaaacctaaatgtagaaagtttaaatgccgttgtacagggggcggtttcttttgactctccagctgacagcccaaaagcagatgaaaatagtcatttcacgctctataccaatttaaaagcggctaaacgtgggattgaaattaaggtaacaattcctgcctcatccgctcttattgcagggcaaacggaagtttattctcaagataatgctatagggattctcgccaagctaagtgcggtagaaaataacgatgaaattttagaaggcagtttattgatagatccaaaccaagcttctttgtttaaagcgaatagcaaaattgtcctacgcaataaaaaaatagatcttggcaatttagcagaaccaaaaaaattctttcgtggcgaatattttgatgtgattgcgggagacggcgaaactaaacatcaatttaacgtgattaaagaaaatgaattattactcaatgcgcctaacacgttagttttaacccttactgcgccagaaaattatggtgtaagcgaagggcaaaatgtgttttataacaatatgataattgggcaaattgtttcacaaacaatagatgtaaatggcgtacaatttaaagcagcaattgcctctgaataccgcaatttaattcacgaaaatacacaatttgtggcagcaaccaattttgatataagcgttggattagatggattgcgttttgaatccgcgacgccagaaaaatggttacaaggcggcgtaagagtattaacgaaacaaggtctggggaaagctaaagatagctatccgctttatcaaaatatcagcaatgctgaacatggcatcacaggaaatattcttacgccaacgataaccttacacacccaaaccttaccaagcattgataaaggctctcttgtactatatcgtcaatttgaagtaggaaaaattttaagtattaaacctaaaacaaataactttgatgtagacatttatatttatcctgcttatcaacatttattgacagataaaagccgtttttgggtagaaagtgcggcaaaaatagatgtaagtccaaaaggcattagtattcaagcaacgccacttgcacgttccttaaaaggggcgattagctttgataatggcggttcaggcaataatcgaacactttatgcaaatgaaagttatgcaaaatccattgggtttgtaattacgttaatcacagatgatgcaactaatcttagcaaaggaatgaatctgcgctatcttggtttagatgtggggcaaattgacagtattcagcttgatgcaaaagcaaaacgcattactgcaaaagccctaataaatccaaattatatgaatataattgcaaaagaaggggctaattttacgataatctcgccacaaatttcggctggtggaatagataaccttgatagtttattacagccttatattgatattgaaattggtaatggaaacacaaaaacacaatttaatttagcacaaacggcaccacaacgtaataaatttagcaatggcacgccgtttattttagaaacgcgtgatgcgatgaatttaagtgaaggttcgccaattctttatcgaggtgtagaagttggcacagtgaagaaatttgaacttaatagtcttggtgatcgtgtgttagtgcatattgccattatgccgaaatatagccatcttgttcgacaaaacacagaattttggatcgcatcaggctacgactttagcttaggctggaaaggtgcggtatttaatacgggtagcgttcagcagttgctaaaaggtgggatttctttctccacaccagcagaaaaagaaattcaaccgcaagcgcagcccaacaaacgtttcttgcttcaaataaaccgccctgaagaagtgcaaacttggggaagtggcgcgttatcaaaataacataaatgaaaatatttaatctgcaccttaatgaattagggtgcagataagctattaccatttttctaatgcttctttatcactctctcttgcttcaatccaacgctcgccttgattggtttgttcttttttccaaaatggtgctttagattttaaaaaatccataatgaattcattggcgtgataagcatctccacgatgtgcggaacttacccccactaaaacaatttcatcgccagtttgtaaaagcccaacacgatgaattaccgatacacgttgaatatcccaacgcactttcgcttgtgcaacaatttcattcaacgctttttcagtcattgcgggataatgttctaagtataaactggatacctcatcgcctaaattaagatcgcgtactttacccacaaaaataaccgttgcgccaattgaatgttgctcagaaagccattggtaaacggcattttgatcaaaaggctgttcttgtaccgcaatttgaatatccgtcatttagccccctgttactggtgggaaaaaggcaatttcatcgccattttttaccgcactttctaaaggcattaaggtttgattaattgccactaaaagtttacctttttccagtgccaatgcccatttatcgcccttttgagcaaggtgttcacgcaccgcttccgcagtggcaaaatcatcttctaattgaatggcatcaacgccaattaattcacgagtttgagcaaaaaataaaacatttaacatcttatttttcctccgcaataaaatggcctgattttccaccgctcttttctaacaggcgaacgtgctcaatcactatgtctttttgtacggctttacacatatcgtaaatggttaaggctgctacgcttgccgcagttagtgcttccatttctacgccagtttttccagttaatttgcaaagagattgaatgcgaacttggttggtttcgagtaacggttctaaattcacttctactttagaaagtaacaatggatggcaaagtgggataagctcccaagtgcgttttgcggcttgaatacccgcaatacgagcagtagcaaatacatcgcctttgtgatgtttaccttccacgatcatggaaagggtttcttttgacatagttacaatggcttcagcacgagcttcacgaacagtttccgctttagcagaaacatccaccatattggcttcgccttgagaattgatatgtgtaaatgtagtcataatataataaaagtgcggttaaaatattgaatgttttaaataagcgacaaaaggaagcagatgaatattaccattcatctcactttgctttttagccaccaatagaagctaaatgatttcttacaccagtatcgccgatatgcaaataatgatgttcacgtttgccttgaagtgcggcaaaaatacgagcctgtaaaataccttgctgttcgtgcgactgcaataaatcacgtaattcaatgccttcttcgccaaataaacaaagatgaagtttaccttttgctgacactcttaaacgattgcaacttgcgcaaaaattcttttcataaggcataattaaaccaatttcgcctgcataatcaggatgcgtgaatactttagcaggaccatcagtatgggatttgtgttgtaatgtccaaccatttttcaacaatttatccgctaagacttgtccagaaagatggaatttatcaaagaaactatccatttcgcccgtttgcatgagttcgataaagcgcatttgaattgggcgatctttaacccaagcgagaaattgttcaaattctttatcattcagatttttcattaaaactgaattgactttaactttgttgtagcccacttcaaatgcacgatcgataccacgcatcacgtcatcaaatttattgatacctgtaatttgatggaacattttgggatcaagactatcaacactgacgttaatagacgtaatccctgctttcttccaatcagccacatcttttgccatgcgatagccgtttgtcgtgacggctaattgacgaatgccatcaatgttagtaatgctttcagcaatagaaataaaatctttgcgtaaagtcggttcgccacccgttaaacggattttctctgtgcccatttcagcaaaggcttgagcaagatgggtaatttcttttaaagttaagaaacttggtttgttagcttcgggttgataaccatcaggtaaacaataagtacaacgaaaattacactgatcggtaatcgacagccgtagatagtaatattgacgttggaaaggatcgactaagcgagactctcctacgtttttaataggaatggattgcattttacacctttctaaatacggagaggataaaccgtttccagcgtatccctgaataacgtagcgcgttattggcttgccaccgtatttctatgaaacttaggctaaacaagctcggagttatgcgttaaatttgatttttcgtcattctaaaagatttcactccataaacacaatcaataatattgatgaaaatcagtattttcctaaattcttaaaaatcaattatataaaaaaatacataatgaatataagactagctcattagtgataattaatcctatttatattaataaccataaatttttagctgattattatgaggnatttttattgatttaaatcataatttaatcaataaataaatttctctacttttcataatcagaaaaatatcctactatttttatcggatttatttttacttaatcaatataggagtgatttatgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaagtaaagcagaaaataatgataaagattggacttcggcatcttatgcggagatgatcgatcacattattactcgttttcataatcgccaccgtgaacaactccctgaattaattacattggcggagaaagtagaaaatatacatggtgatcgtgatgactgtcctataggcgtagtcgcacagttagaaaaaatttatgctgaacttagccagcatttaatgaaagaagaacaaattttgttcccaatgatcaaaatggggaattatgctatggcctcaatgccaattcgtgtaatggaaatggaacacgatgaagcaggacaagatgtggaagtgatcaaatcgcttactaataactgcacgccaccagcagatgcttgtttcagttggaaagccttatatagcggtattaatgaatttattgatgatttaatgcatcatattcatttggaaaataatattttatttccacgtgtattaaacgaaaaataatttaatattcgtcaaaaaataaccgcactttaatctattccgaaaaacaaactaaagtgcggtcatttttacaagcgttttgagttggtcgataagccgagttctgtcgtggacaatcattcctctaggcgacaaattactctgccgctcaagcaacctacccgaactctggacgggccacccattgagttcctatttggtcttgctacgagtggagtttaccctgctgcacgttgttaccaacggcacggtgcgctcttaccgcaccctttcacccttaccgtttacacggcggtctgctctctgttgcactggtcgtcggctcacgccgcccggacgttatccggcactctgccctgtgtagctcggactttcctctcgtttacttgtcccactaggtcgtataaatacggttaagggcttcaataaaccagcgattgtctaaccaactcggcgcgtagtataggggcaatcactagtgcggtcaataaaatccccaatttttgaatattgcttcatcaatcttatcaacaataatgcctaatttttcattcgtatttttttatgattccgctaaaataacgccaatttcaaccgctcttttaggaagaagaatgaactatctaaaaattgcacaggattccctttcagtggaaagtaacgcacttttgcaactcagccaacgcttaggcgacgattttaatcaagtcatcgatcttattttagcctgcgaagggcgtttggtaatcggagggatcggaaaatcgggtttaatcggcaaaaaaatggtagctacctttgcctctacgggtacaccaagtttctttttacatccaacagaagccttccacggcgatttaggtatgttaaaaccaattgatatcgtgatgttaatttcctatagcggtgaaaccgatgatgtcaataaactgattccaagtttaaaaaatttcggtaataaaattattgctgtgacgagtaacaaaaattccacgctcgcacgccatgcagattatgttctagatataactgttgagcgtgaagtctgtccaaataatcttgcgccaaccacttccgcacttgtcacactagcccttggcgatgcacttgccgtatcgcttattacggcacgcaatttccaaccagctgactttgccaaattccatccaggtggcagtcttggtcgtcgtttattatgtaaagtgaaagatcaaatgcaaactcgcctaccaacaattttacccaccaccaattttactgactgcctcacagtcatgaatgaagggcgaatgggcgttgccttagtgatggaaaatgagcaacttaaaggtattatcacggatggcgatattcgccgcgcgcttacagccaatggtgcaggaacgctgaataaaacagccaaagactttatgacaagttcaccaaaaactattcatcaagacgaatttttatcaaaagccgaagactttatgaaagcgaaaaaaattcactcgctagtcgttgttaatgatgaaaatcacgtagtgggtttagtggaattttcaagctaaggaatcccgatgcaacaaaaattagaaaatattaaatttgtcattactgatgtagacggcgtactcactgatggacaacttcattatgatgccaatggtgaagccatcaaaagctttcatgtacgagatggtttaggcataaaaatgctgatggatgcggatattcaagtggcagtgctttctggtcgcgactcccctattttacgtcgtcgcattgccgatcttggtattaaattattctttcttggcaaacttgaaaaagaaacggcttgttttgatctcatgaaacaagctggcgtcaccgccgagcaaaccgcttatattggcgatgatagcgtagatctccccgcctttgcagcgtgtggaacttcttttgctgtggctgatgcccctatttatgtgaaaaatgctgttgatcatgtactttccacccatggcggcaaaggcgcattccgtgaaatgtccgatatgattttacaggcacagggaaaatcttctgtgtttgataccgcccaaggtttcctaaaatcagtgaaaagtatggggcagtaataactcattcgtcaatgttattgcctaataaaaaataaagtgcggtcaattttcaaagcgttttaaaatctctcaaaaatcaaccgcacttttatatttataacgctcccgcactctgacagtttatctctttcttaaaatacccataaaattgtggcaatagttgggtaatcaaattcaattgttgatacggcaaactaaagacggcgcgttcttctgcggtcatctcttgtttttccaattcttttaaatgtgtttcgatactttcttgctgttggttaaaaatagcctcaggtatttcttcaatatgttctaaggtataaataattttctttgccacaggataaaaaccagataaaaactgtgcggtctgttgcaaatttttcattctgtcgcgataagctcccagtgctgaaatatagcttaatagagaataattaagtttgagcaaatcaaaacctttctgtaaatatgccttatatttcactggctcattattcatattagaaagcgttgtactcagtgcggctgcatattgatgcgcattgcgacgtgctatgcgatatttaagatcgtcacttttaccaaattgcaattggctaataatatgcaataaatacaccgcatcactacgcaatgcttgatggctcactttatcaagttgcaaatatttccaatctggccataagtaagatacggcaaaccatgaaatcgcggcaccaagtaatgtatcaagtaaacgaggcattaaggcggctgccgtatcaaatcccatgacatcaaaactgagcaatacttgcagtgtgatgaaaaaggtcgagaaactgtaattattactacgaaagaaaaagaacaacgtgcttgtaagcaccacaagacccagttttaattctaaggttggatttaaataaggtaatagagaccccaccactacgcctaatatcgtgccgataatgcgctgacgtaaacgtactttagttgcagaataatttggctgacacacaaatacagtggtcaataaaatccaataaccaagattaaattggaaaaactcaacaattgcacagcacaaaaataccacaatagataagcgtactgcatgacggaacaacggtgactcaaaagtaaaatggctaaaaatcaccgcactgatattttttaacccagtgatttgttccgtatgaatttgagctaattgttctgtaaccgtcgtgtcttgtgctaactggcgaagttgccagttaatactttgtaaattatctaacaaggtttgaatatcaatcagttcatcttgatcattaagatgttgtgctcgatatagatcaaaggaatgcaaggtgcctaaaagcgcacgttcgacacgtttattaaaatgatagggtttattttcacgcaaactcgccgtaatttctttacaggattgtgcttgtagttctaacaaacgttgaatacggaaaatcaaatctgtattttttagtttttccgttatttgttgataatcaaaatgcgtagaattggcgcgctcatgaatgtcttgtgcggcaaaatagtaacgtaacattctctgagtaagaggatggcgatgttgccctctaatgcgataaaaaagcgcggtgcgaacaatattaaatgccgtgacaacattcgcatttttcatcgcgaaattaagatgttttttttcaatctcagccacttcgtcaggatcaaaaaaacaggatttggtatctaaatattcgcccaacgcacaaaacgctttagcgacactttcttgcacggggcgatttgggaaaaacaggtaaacaatcagagtcaccacgctatacagcaaggtaccgcataaaatcattacagggttaataaaccatacatttacctctgggatataagttaatgtggtgtaaagcgcaaccactaatgaaccgaaagcaatggtgctataacgctgccccacggcaccaatcatagtgaaaataaatgtcagcaccgtcattaacacaatatattggataggcttgccaatatgtaactgcacaataaaggaagaaatagaaaaggcaataagggtaaaaaatacgtttttcaatcgtccagttaaacggttatccaaatccaccaaaccacctgcaataatccctagaatcaaaggcattgattgcgaagaaatatcaaaaaaccatattcccactgccgcaatatttacggcaataaaaacaggaattgtagaaattactttagcatttaaccgaatattcatttcaaatccttatcaaaatagaaaagtgagcaacaaggctcactttttattgtataaagtgcggtcattatttatgggattttgcccagtttaagaaacgtgtttgagtttctttatccgcttgttggaaccaatattgaagctgttgctctgcaacgttttcgccctgaacaaccacttttcctttattcgcttttgcattacctgctggcgcaacagccactgaactcgcaactgttgttgcagcaaatttagaaactgatgccgctgcaccagacgcattatattcagcaagatcatttagcacattaccacttgggaataaaccttcttgttttaacacatccactttcgctgaaatagcattacctgattttgttttcacagtaatatttggcatttgattgaatttatcgccactatcaagattacgaataactggtgcggaaataactaaatcttcagcattaccttgaaatgtcacaatcacaggattagattcaaaaagagattgattcgatcctgaaccaacaatttcatttaaacgcacaacaacctgatggttttgggtatcatctacagtaaatgtcttagcttttccgagagatttagaggctttttgaccatcaatcgctaaaaactcaaggttagatgacgtagaaaccattccagcaaaggttgccgtacttgtgcataatgtggcaagacctaatacaacagcgcgtaatttcataattgctcctttggtataaatgaaatactcgcttatgctatgccaaattagccaaaatgaaaataaaaagtaagaattaatttaaaattttttgttataaatagcacaaacaatcacaatgttttattatgttggcgatctacacactaaaccagtgtcgtgaaaatttaatccattaaatatcaacgggagtaacaatgttgaacgatattttaacaggctatggaatttttattttggaaattttaacaattttattactcattcttgctgttgttggtttgattatttcttatcgccaacataacaagtctaaagtgggagaattagaaattaaagatttatcagaagaatttaatgaacaagttcgtttattacgtgattttaatctttctgaagaagaacaaaaacaacgcactaaagctgaaaaaaaagcggaaaaacaaaatgctaaaaaacgcaaagaaaaattgaaaaaaggcgagactttagaagatgaaaagaaagcttgcgtatatgtattagatttttgcggcgatatttcagcctcagaaacaaccgcacttcgagaagaaatttcagctatcttaaatgtcgccaaatctgaagatgaagtattactacgtttagaaagtcctggtggcattgtgcataattatggatttgcagcctctcaattgtctcgcttaaaacaaaaaggcataaaattaactgttgccgttgataaagtggctgcaagtggcggttatatgatggcttgcgttgccgataaaattgtatccgcaccttttgctgttattggttctattggcgttgtcgctcaaattccaaatgttcatcgactattgaaaaaacacgatgtcgatgtagatgtaatgactgcgggcgaatttaaacgtacagtgaccgtattgggtgagaacactgaaaaaggaaaacaaaaatttcaacaagaattggaagaaacacataaattattcaaacaatttgtctcacaaaatcgcccttgcctagatattgataaaattgcaacaggcgaacattggtttggacaacaagccattgcattacaacttgtagatgaaatctcaacgagtgatgatttaattttggaaaaaatgaaagaaaaacaggtacttaatgttaaataccgtttaaaaaaatccctaataaaaaaattcggacgacaagctgaagaaagtgcaattaatatcattcatcgttatagtacaaaacagtctagagactttatgtactaaacatttacccacaaaaaagaagtttttatttctatgtttacaagncaaatctttgtcattaagatactcgccgatctttaggggttttattatatttaattcataaatcaagttgagtattgttaatccaaatattgcgcagctaatcgtttaaatgattagctgcgttttttattttaataacaaaatcgcaacttaccatttccccttagcaaaattttctattgttcttgcttccataaatagggataataacgcccctattcaaaaggcaaaaaataatgacgcactatattttattgattatcggcaccgcattaattaacaattttgtattggtaaaattcttaggtctttgcccttttatgggtgtatccaaaaaaattgaaacggctgtgggaatgggattagcaacaatgtttgttttaactgttgcttccctttgtgcatatttggtcgatcactatattctaattcccttaaatgccacttttttacgtacattagtgtttattttagttattgctgtagtggtgcaatttaccgaaatggcaataaacaaaacaagtccaacattatatcgtttactcggcattttcttgcctttgataactacaaactgcgcagtacttggtgtcgcattattaaatgtaaatctcgctcataatttaacaggagtctgtcgtttatggttttggtgcatctctcggcttttccttagtattggtactttttgccgcgcttcgtgaacgtttagtcgccgctgatatacctgccacttttcgcggttcatccattgctttaattaccgcaggcttaatgtccctcgcttttatgggatttacaggacttgtaaaataataaaatgatttaccttttaatgataataactctgttaattttatttattgggttctctcagtatttttcaggaaaaagaaagaaataatgacctttttattcatcgtaattacgctactcgctttaattttcggtgcgattttgggctttgcatcaatcaagctcaaagtggaagctgawcctgtcgtagagaaaattgatgctattttaccgcaaagccaatgtgggcaatgtggttatcctggttgtaagccttatgctgaagccatttgcaatggcgatgaaatcacaaaatgtattccaggtggtcaaacaactatcgtaaaaattgccgaaattttaggggttgatgtaccaacaatggagggcatagaagaacctatcgagaaagttgcttttattgatgaaaatatgtgtattggctgcacaaaatgtatccaagcctgtcccgttgatgccattattggtacaaataaagcaatgcacacgattattcccgatctttgtacaggttgcgagctttgtgttgcgccctgcccgacagattgtattttaatgattcccgtgaaaaaaaatattgataattgggattggaaatttgatgcaaaactcgttattccagtaatgaatgtcgatggctctgaaaaaaaattggttgtgggggaataaatggcggacgtattatctcgtttcaattccggtaaattatgggatttcaaaggtggcattcatccaccagaaatgaaatctcaatctaattcacagccattacgccatctgcctctcggcacggatttttacattccactcaaacagcacctaggaacaacaggcaatcttttaataaaagagggcgattacgtcttaaaaggacaagccttaacaaaaggcgatggcttgcgtatgttgccagttcacgcgcccacttctggcacaattaaatcgattaaaccttatgttgccacgcatccttcaggtcttgatgaacccacaattcatttacaggcggatggtttagatcaatggatcgaacgtaatcctattgatgatttttcaacgctatcgtcagaacaacttattcacaaaatctatcaagcaggtatagcaggtttaggcggtgcagtattcccaactgctgccaaaattcagtcagcagagcaaaaagtcaaactcttaattatcaatggtgcagaatgtgagccttatatcacttgtgatgatcgtcttatgcgtgaacgtgctgatgaaatcataaaaggcattcgtattttacgttatatattgcaccctgaaaaagttgtcattgccattgaagataacaaaccagaagccatatcggcaatccgcaatgcactacagggagcaaatgatattagcattcgggttattccaacaaaatatccttcaggtgctaccaaacaactgatttatttgctcacagggatagaagtgccaagtggtgagcgttcatccagcattggcgtattaatgcaaaatgtgggaacaatgttcgcaataaaaagagcaattataaatgacgagcctttaattgagcgtgttgtcacccttactggaaataaaatcgctgaaaaaggcaattattgggtgcgtcttggcacacccatttcccaaatattgagcgatgcgggctatcaatttgacaagcattttcctatatttgcaggtgggccaatgatggggctagagcttccaaacctaaatgcacctgtgacaaaacttgtcaattgtttacttgcgccagattatcttgaatatgccgaacctgaagcagaacaggcttgtattcgttgttctagctgttctgatgcctgcccagtaaatttaatgccacaacaactttattggtttgcgcgcagtgaagatcacaaaaaatcggaagaatacgctctcaaagattgtattgaatgtggaatttgcgcatacgtatgcccaagccatattcctctaattcaatatttccgccaagaaaaagctaaaatctggcaaataaaagaaaaacaaaagaaatcagatgaagccaaaattcgctttgaagcaaaacaagcacggatggaacgtgaagaacaagagcgtaaagcgcgttcacaacgtgcagcacaggctcgccgtgaagaattagcacaaactaaaggggaagatccagtcaaggcggcactcgaacgcttgaaagcgaaaaaagccaatgaaacagaatcaacgcagattaaaacactaacctcagaaaaaggagaagttttacctgataacacagatttaatggcacaacgtaaggcacgccgtttagctcgtcagcaagcagcatctcaagtcgaaaatcaagaacaacaaactcagccaaccaatgcgaaaaaagcagcagttgcagccgcacttgctcgtgcaaaagcaaaaaaacttgcacaagcaaatagcaccagcgaagctatttcaaactctcaaaccgcagaaaatcaagtagaaaaaacaaaaagtgcggtagaaaaaacacaagaaaattcaaccgcacttgatcctaaaaaagcagccgtagccgccgccattgctcgagcaaaggcaaaaaaacttgcacaaacaaatagcaccagcgaagctatttcaaactctcaaaccgcagaaaatgaagtagaaaaaacaaaaagtgcggtagaaaaaacagaagaaaattcaaccgcacttgatgcgaaaaaagcagccatagccgccgccattgctcgggcgaaagcaaaaaaacttgcacaagcaaatagcgccagcgaagctatttcaaactctcaaaccgcagaaaatgaagtagaaaaaacaaaaagtgcggtagaaaaaacacaacaaaattcaaccgcacttgaccctaaaaaagcagccgtagccgccgccattgctcgggcaaaagcaaaaaaacttgcgcaagcaaatagcaccagcgaagctatttcaaactctcaaaccgcagaaaatgaagtagaaaaaacaaaaagtgcggtagaaaaaacacaagaaaattcaaccgcacttgaccctaaaaaagcagccgtagccgccgccattgctcgggcaaaagcgaagaaactggcaaaaacacaagcaacattagaaaataatcaggaataaaataatgtttaaaatggttagctccccacatactcattcaggaaaactcacagcgcatattatgctttgggccattttggcaatgatgcccgcttttttcacgcaaatttattattttggatttggcgtggtgcttcaatccgcattagccattggtacggcaatcattgcggaatttattgcaataaaattacgaggtaaaaaaccgctcaattatctttcagatttcagcgtagccctgactgcgttaattttggcaatggctattccaccttatgcaccttattggattatcatcattggaacactctgtgcagttttattaggtaaacaggtttatggggggttagggcaaaatccattcaatcccgcgatgattggctatgtaattcttctaatttcattcccattacaaatgacaacttggatgccaccaattaatttattacaggaaccaccgactttttcagatgcattttcattaatattttcaggtttaaccactgatggatttacgctttcacaacttacgcataacattgatggtatcacccaagcaacgcctttggatagtgcaaaaattttctataaaagtcacactcaattaaatgatttttatgagctaattaaactacctatatttatgggtaatggaactgatttcgctcaaggatggtggcaaatcaacgtggctttcttagcgggcggaattttccttattttaaaacgtgtcattcactggcaaattccagtggcgatgcttgtcacctttttctgtttagccactgcgaccgcttttactggcttcacgcatttaagtgcgattagccaactcgttagtggcgcaatgatgtttggtgcattttttattgcaacagatcctgtcacagcctccattacaccacgcggaaaaattatttttggcgcattagtggggttatttgtttatctcattcgttatcacggaaattatccagacggcgtggcattcgccattttattaagtaatatttgcgtcccacttatcgatcattacacacgtccgcgcgtatctggttatccaacaaaaggaagaaaataatgggtacagtaaaaatcacatcgcgttatggcatattgttaggctttattgccctactttgcacaataatttctgcaggaattttcttcctaacaaaagataaaattgatgcggtaatcgcagcacaacagcgagaattacttctacaagttatcccacaagattatttcaacaataatttgctagaaagtgcggttattccccaagataaaaattttgtgggtatccaaaaaatttattttgcgaaaaaagatggaaatgtttctgcctatgcctatgaaaccaccgcgccagatggttactctggtgatattcgcttgcttgtgggattagatccgaaaggcgaagtgttaggcgtacgagtaatcgaacatcacgaaacaccaggcttaggcgataaaattgaacgccgaatttctaactggattttaggtttcacaaatcaatcgattaatgaacataatttaagcgaatgggcggtaaaaaaagatggcggaaaatttgatcaattttctggtgcaaccattacacctcgcgcagtggttaatcaaactaaacgatcagcattaatcatgctaaataatcaagccttgttacaacagctttcaacacaagtgaaataatatgacagatttaactgaaaaaaataccgcacttgaagaagaaaaaatagaaagtgcggttgaaaatcaacaaaaatccatctggaaagaaatttttgctcaaggaatttggaaaaataatcctgcggttgtccaacttctcgggctctgtccgctgttagcggtgtctagcaccgccaccaatgcacttggtttaggtttagcgacaatgcttgtactcacttgcacaaatacggtcatttcccttttccgtcaatatattcctaaggaaatccgtattccaatctacgtaatgatcattgcaaccacagtaacagcggttcaacttttaatgaatgcttacacttatacgctttatcaatcactggggatttttattccattaattgtgaccaactgtattattatcggtcgcgcagaagcattcgcctcaaaaaacagcttactccattccatctgggatgggttttcaatgggattaggaatggcacttagtctaaccatactcggcgcattacgtgaaattattggacaaggcacgatttttgagggcatagaaaatctattcggcgaacaagcaaaatttttaacgcaccatatttaccatacagacagtagctttttacttttcattctgccaccaggcgcatttataggcttaggcttgctcctcgccataaaaaatcgaattgataatataaaaaaataaagcaaccaaatcttgccttcccctgcttgcgggggaaggtatcacaaagtgacaaaaagaggctcaaagaaaatcttgccttcccctgcttgcgggggaaagtgtcacgaagcgacggaagggggcttacagtcttctaaacagataattccaataaattaaataggctaatttctacaaaaatatgaacaaaacaaaaagaatcgaaatactcacaagattacgagagcaaaacccccacccgaccacagaattacagtataattcgccctttgaattattaattgcggtcattctatcggcgcaagcaaccgataaaggcgtgaataaagcaacagaaaaactattccccgtggcaaacacgcctcaagcgattttagatttaggattagatggtttaaaaagctatattaaaactatcgggctttttaatagcaaagcagaaaatattatcaaaacttgccgagatttaattgaaaagcacaacggtgaagtgcccgaaaatcgcgaagccttagaagcattagcgggtgtgggtagaaaaacagccaatgttgtgctaaatacggcatttggtcatccaactattgcggtagatacccatattttccgtgtatgcaatcgcactaattttgcagcgggtaaagatgtggtaaaagtggaagaaaagctgcttaaagtcgtacctaatgaatttaaagtggatgttcatcattggctaattttacacggacgctatacttgtatcgcgcgtaaacctcgttgtggatcttgcattattgaagatctttgtgaatataaagaaaaagttgaattttaattttgcggtaaaacaacctaattatttaccgcacttttattaaaaataggataaaaaatgacaacaaacaataaacagcgacaaacttggtcgagccgcctcacttatgtaatgacggtcgcaggcgcaacagtcggtttcggtgcaacttggcgtttcccttatcttgtgggtgaaaatggtggcggtgcttacgttttacttttctgtatcgcaatgattgtaatcggtatcccaatgattttagttgaaaacgtgataggtcgccgcttacgtgtaaattccattgatgcattcggcgataaaattctcgacaaaggaaaaggcatttctaaatattggaaaatattaggttatatgggcttactcggcgcatttggcattatggcgtattatatggtgcttggtggctgggttatttcttatatcattagcctaatcagcggtaccttagacatttcaacccccatcacaaaagacattgccaaaaatttctacgatcttcacatcggcaatagcccttatgaaattatattctacactctcttatttgttatcgtgaattacattatcttggcaaaaggtatcattggtggaattgaacgttcggtaaaatatttaatgccattactatttatcttcttaattggaatggtaattcgcaacgtaacattaccgggtgcaatggaaggcattacattctatttaaaaccagatttcagcaaaattaccccacaattatttatctttgttttagggcaagtcttcttcgcattaagccttggttttggcgtattaattaccctttccagttacttaaataaagaagaaaacttaatccacaccgccgtaattacaggtttcaccaacacaattattgccgtacttgctggctttatgattttcccctcacttttcacttttgggattgaaccaaacgcagggccaacattagtattccaaagtttacctatcgtattttctcacttatgggcaggcaaattctttgcgattatcttcttcggcttattattaattgctgcgctgactacttccatcacaatttatgaagtgatcattacagcattacaagaaaagctcagaatgtgccgtggcaaagccattgtcttaacccttagtggcatttttctattaggcaatatccctgcaattttaggcgataatctatggaaaaacgtaaccattttcggcaaaagcatttttgatttctacgattacgccagtggaaatattctctttatgctgaccgcacttggctgtgctattttcgttggtttcgtgttaaaagatgaagccaaaaaagaactttcttcaacaaaatattcaactttcatcaaaatttggtttaactacgtgaaatttgttgtacccttgatcatcttagttatctttatcagcaacctgttctaaaaattaaaaatgcggtaaggcgactacattaccgacaccgctttaatttgaacataaacatcttgcccaatagcaaaacgcagttcattttgcgcccatttactaatgcttgcccaaatcttatgcccttccactaatacggcaagatccactcgagaatcttgtatctcaatttgtgtaattttgccacgtaaaatattacgaatgcttgtttgttctggcttttgcagagtgatagaaacatctgaactataaatacaaactcgcactcgctcgcctacattcgcgggtacttgatgaatccaaagcacttgttcgcctagcgaaagtgcggtcattttataaggtggattatgcaaatgaacgggcaaggcaagtacactgctctgttcgctttctcctttccaaggggcaaaaatagggctattccaaattttttctactctgtcataggctttcacaatgccgttttccatcagcacaacgcgatcagctaaacgcaacagttcgtccaagctatgtgtaacatataaaatcgggatattaatttctttagaaagacgttccaaatattgcattagctcgcgtttgcggggaacatcaagggcagaaagtggttcgtccatcagtaaaatatcaggatcagtcagcagcgcacgccctattgccacacgttgtttctctccgccagaaagcgtgagcggataacgctttaataaatgagtaatgccgagaagatcgacaatatagttaaaatcatcttgcgatacgtttttcatgccatagcgcaaattacctttcactgtgtagtgaggaaataagcgtgcatcttggaatacatagccaattttacgcaagtgggtcggcaatgattcttggctttccatatccactaaagtgcggtcatttaaacagatgaatccttcgtctggttgtatcaagccactgacaagattaatcaacgatgttttgcctgagccagacaaaccgaaaatagcggttacaccttgatctggcacttgtatattcgcttgcaaggcaagttgcccgagctgttttttcacattaatctgcaacatttccttgtcctaattttttctgcatccgcttgctcaaccactctgacaatagcaaagaaatcaatgaaagaatgatagcaaataaacataagcgagcagtttgttcttctgcacctggtgtttgaataaaagaatacatcgcaaggggaatcgtttgagtttcgcctgcaatgttcgatacaaacgtaatggtcgcgccaaattctcctaatgatcgagcaaaaccaagcacgagtccagctaaaacccccggtaaagaaagcggcaaggttattgtaaaaaatacacgccaagcggaagcacccaatgtttgcgccgcttgctccaatttaatatcaatattttctaaagaaagtcgaatcgcgcgaacaaccaatggaaaggcaaccacggcagaggaaagcaccgcccccttccaactaaagccaaaagataagccaaaccactgatataaatacttgccaatgaaaccattgcgccccattgccacaagcaatagataaccgataaccacaggtggcaacactaaaggcaaatgaattacgccagtaatcagggatttaccatagaagtttttgcgcgctaagagccacgccacaaaaatggctaacggcaaactccaaagcatggaactgactgcaacactcaggcttaaattaattgctgagatttccattggcgtcagattgaaaaatgaaaaaaattgggtaagcaaaatgaatccttatctaaatagcctctctttaaatcccttgtttatgggaatatcccacattgatgagaggtaagatgctctataataacaaaagggcagaaatatccgcccttcatgactattaagattctatcttattttgcagagaaaccataccctacaagcactttcttcgcagcatctgattctaaatatttcaagaaatcgcgagaatccgcattatcatgaccttttacaatagaaacgggataaacaactggtttatggctatcagctgggaacactgcaaccgttttaacttgttgactaacttttgcatcagtgctgtacacaataccgtaaggtgcttctgcacgttcaactaaagctaatgcaccacgcacatcttttccacgcgctaaacgatcttttaccttatcccataaatttaatttggttaatgcttcttctgcatattgccccgcaggcacgtgcgcaggatcgccaacagataaatagctatcttttaatgcattgatccattcacctttagcaatatccacagaatttaccgcactttttgctggtgcgattaagactaaatcattacccactaaaactttttcggtttcttttacggttaaatctttttcagaaagatatttcatccatttattgcttgcagatacaaaaatatccgctggtgcgccttcttcaacttgttttgctaaagttgaagaagaagcgaaagaaaacactacttcatttttcggattttgttttgcgtaatcttttgcaacttgttgtaaagcatctgtcattgaagcggctgcaaatacagtcactttagcggatgccgcaaaagaaaagcctaatcctgcgattaaaagtgcggttgaaattttagttaattttttcataaatcatctcctacgattaaacgttatttacttgattatatattgaaataaataacaatcatatagcaaaagaaaaattatttagtaaaatatataacgcttaggcttaccacttaggattacttaggaacagcaaaatgaaaaacaccgaaattttactcaccattaaacttcaacaagcactttttatcgatccaaaacgagttcgtttactcaaagaaattcaacaatgcggttcaattaatcaagctgcgaaaaatgccaaagtgagctataaaagtgcgtgggatcatttagaagccatgaataaaatcagccctcgcccattgctggaacgaaatacaggtggaaaaaatggcggaggcacggcacttactacttatgccgagcgtttgctccaactttatgatttattagaacgtacgcaagaacacgcgtttcatattctacaagatgaatccgtaccgttagatagtttactcacggcaaccgcacgtttttctttacaaagtagcgcacgcaatcaattttttgggcgagtggcacaacaacgcattattgactctcgttgcgttgtggatgtgaatgtgcaaggattaccaacgccattgcaagtttctattaccacaaaaagctcggctcgtttgaaactcattacggaaaaagaagtgatgctgatgttcaaggctccttgggtaaaaatcagtgaacaaccattagcaaatcaaccgaatcagttccccgtaaatatcaaatcactcaatgaagaggaagccatccttcaatttgctgaaagcaacattgaattttgtgccacagtccaccagccaaatcaatggcaaatcgagcaacaggtttggattcacattgatcaagagcaaattattttagcgacgctggggtaattcagagatataatacgtaaattcaatacttatattattgttttctgaactaaaataaccttaaatcaaacaaaattttaaataaaatatttaatttcatcgtatttcctatttacgtaaaaaagtttgataaagttttttcaataacgaggttggcaataaacgagaaccaaaacgcaatgcaaaagtaaataatccagataacaaaccctgaattcccaaacggtatttcaatttgaacaaacgccattctgctttagcttgattgacgccacgacgacgacttaccatgccatttcctactcgagcataaactaaaatatctggcaaattcgccatatataaaccttgtgcgacaagtttgatccacaaataataatcttcttgaagatcttcatatccaccacaattaatgaccgcacttttttgatatgccaccgtcatgtgattaaacggacaacgtttttgcgtgaatttgataatttcttgagcagacgttggcacattacgatatgccacaatatcatttacatttttaccaaattcagcaatttgtccgccaaaaatgatgctttcagggtgctgttcaataaacgctacttgcttttcaaaacgatcaggcacgcaaatatcatccgtatccatacggaaaacccagtcataatcacaatgcaataaaccctcgtttaaggctttgcctaatcctcgattttgtggcaatttaactaattttaatggcaattttgtttcaaattctgtcacaacaaattctaaatctggcgttactacgccatcaaaaaccaagacaatttcatctgcttgacgagtttgtgcaacaagactttcaaaacactcccgcaagaattgaggattttccttaatatataaggacataaggactgaaaatttcattttattttcccaaccgttttaaattaatagctaattttggcgaaattaaaataaccaaagtaataataaattgcttaatactttttgttttcttaaaaatatcaaaataatattttgccgctttacgcgataaattcataatatggggataagccaaaatatagctcgcgttaatatcaaaattacgagcttgctctaccgttttcacataatgctcgcgaatataatcaatggctttttgcgtattagtggtatccgtagacacacttgagcgtttggtatggaaagtacaataagttagtggttcattaattttataaggagtaaaacttggctcttgtagcagttttaacaagaaatcatagtcttccaaagaacgaagtgcggtggataatccacctatttttaaaaacatctcttttttaatcgcaatcattggcatgccaccaatcttattggctaacaaaatacgttctgtcgaaatttcttggggttcaatcggttgagtcacataggtaaacccttcattaaccatttcacacttagctggatgataaataaaattaatattcggattttgctcaatcacttgtagtactttttcacatttttccggcataaaacaatcatcatcatcgagaaaaagcaaccaatcgccctttgatgtacgcgcaccaacattacgactttccgctgcaccttgattggtttcgttacgaatcactgtaactggaaaagaataactttgttcaacaactactctctctttggagcaatcatccacaataatcacttcaaaattactcgatgtttgttgagttaaactttctaataaagctggcacttctgcttttcgattataagaaggcacaataatgcttaacataattccttcctttaattagccaaatttttcttaatcgcaaagatttttttcaatggatatttcattaattttttaagtaaattattggataaagatccacgaacactttctaaattactgatcaatacaggattttcaatgactatgagagggcgaaccactttatttcttatattaaaattctgttcaaagagtaaaaaatcatccgctaaccaaaatggtttgttttgagaaatttgctgaataaatcttcttgctgctgattttttaataagatagcccacagttcctgcaaaataacttttataagggaaagcgtaatttacatcgcctgtttttttgcataaaaaagaaaaggttgtcggataattaatttctaaatcaaaatcattgaaatcattaatttttgactgtccaagcaatataatttcagcctcaagtttttctgataaaagtgcggttaaattttgctgaaaatctgagtggaataaagcatcgtcttcacagactaacgcatagctatcttcagcaatatcgttgtcttcaacaattttttgatataccgaaagatggcttaatgtacaaccgatctcgcccttagtgacattacgaaaataatgtgctttaaattgttcaatattaaaaatagcagctaattcatcccaatctttttgcatggtattaatggccgaaaacacttggaaatcctcagtatttttttgagaaaagaataattcccgacgttgaatatctttatctaaagagancaaatatttttttaacataaaattatnccttataaaatccctttccattcttcaataattttctcaatgccataatcntcactcattaaacgagatttgtctgacatttgtagataaagntcaggattattgattaataaatctaaacctttaaccatttcttcaatattattttgttcacaaagaaaaccattttctttatgttccactaattgctttacgccaggagaacaattaaaggcaacaataggtaagccaaatgccatcgcttcaataacgactaaaggcaagccttctgtttgtgaaggtaaacaataaattgaactgctttcataataaaaagaaacatcattagtacgaggaataaaattaactgaatcttcaatatccaatgctttagcaagattttttaaattttcttcttcctcgccagaacccactatttttaaattccaatctggatatttttttgccaaaacttgccaaacttttaataaataatcaaaacctttataagaaaataaatgccctacagatagaatagttttattttccaattttgctaatttgttctttggcaaaagcgtatttggattagcaatactaattatattatttgttttaaatttttcttgccacagcgttttttctgcttctgtcaatgtaactattttatcgcaagttgttacagctaaatatttaccgagcgtgcgaacgagacgattgcccgtaaaattaaaagaataatgctcccataaaatatgttttatatttaaattaaccaacgccaaagcagnaaaaagcataattgcaccatcaaccacaattaaggtatccagctgtaattctttaactaattctcttaattttttagtgatagaaaaataatcttttttcaatgaatagggcaatttattcattgcgtaaatattaattttttcatcaacttggaaaaaaggcttgttaccgccaatgctaataaaagaaacatcatatccctgtttagcaagagcattagcaacattaatagaaacgcgctccgttcccccnggacttccgatattcattataaagaaaccaatttttttcattttaaatttccttataaatcgttaatccaaggtctggaaatgaatcgtaacagaattgccatcttggaatactcgttctaataaaacggatttctacattaggatgacttaataaattaaatgcaacagaactgaagaacgtataaataattattttnttatttgataaatgtttaaatacgtaatcttcaaaaattaattcagattcaacataatttaccccatcaactcgataatcttctgctggatgggggaaataataatcaaaaggaatctgatcttttaatttttttattaatgagatgttttcctcttttgtatttaacaatggttgtccaataaaaaatgagacctcgccatctatctcgcaatctatttgattatcccataaagaaattggttcaatattagaaacaatatttttgtaattaggataaaccgtataatgtttttttatttttttaaataatttattcacactatatttatcgccaataaaagctttaatcagtttatatttaaatgtgccaggctctctcaataaattaggatgtgggaaaatattatctgaaccatcatcaaaggtataaagctctttaaatgaaacatgactaagataagtttgtagccataatgaattaagattggcgagaaaaaccttatcaaaacctttgtgcgtaattttattcttaagctggcgcattaacttgagaaaatcgaaaccttttagatcttttcccgtatcaatattcatcgaatcactacaaacctccgctaatttactcgcatacaaggttctttttttatcccatacaccaccaaacattacgccaaagaattgctcgttaggatgtaattcaattatttttctcgcaattaatacttgcaatggtgtacaacaaagcatgagattcatagggttttactcactttagatgtcataaaataaagaataggaataatggaaagcgaaccaataattccagcataagggatatatttaatttctgtaaaagttaaagctacaaggcttgccacataaatgattgtagataaaacggaacattgggaaataagtttatttttcccataatagaaaagataattaactaaaatcaaataaggaatacttaatgtggtcgaaattaaaaataaaataaaataatatttcgttcccacaaattgactacctaaaatccaaactaacacatcctcaggaataatccacattattaaggcaggaataggtattagcaaaaaggaaaataacgcccatttatgtaactgttgaacaactaattttttttgttttaaggcttcataaaaataggggataatcgctttattaagtgcttgaatagcaattgaaacgactaaagcaagttgtgcgcccatggcataaagccctaaatctgtttcactgaatttgtgatagataaaaatacgatctaactgcccttttaagaaaaaacttgcataatgtaaaataagcggcaatccaaatcctaaaatataaaataatgcggattgataatgtttaaattgatatttcttagatgtcgtactctttctgtaaagaaaataagaaaaaaaccagacgactaaattgctcaataaaattgccaaaattcttttttcaacaagatcattttgataatactcaagcaatgcgaccgtaaatacagctcccgtaacagtaagtgaaaattgaataaaagcataagaccaagcctttttctggcattgtcttacacttagctgaacatttaagaaagattggaaaattgaggaaagtgcagcgtaaaataatatttcagactgagcaatccaacagccaattaaaataatactgccgattatcgtggtataagcatagccggtatttaccactaaatttaatgaacgttttccgtaaaaataaaaataacgggaaattgcgccttcttgggttaaagaaaccacaattaaaaataaacttaaaaaagtttgataataagaaagtgagccatacccttctacgcccaatttacgggataaataaggcaaaagcaaaaaaggaactaactttgacgataattccccaacaaggtaaataacactgtctttaaaaactttcataaatatcaccgcacttttgatgaattcgagcgttcgtttatcaaaaaataagggggcttattttaacaaaatcaacatagacaagctatgactaatcattataatgaaaccgctctatatcaaggatcttatctatgttagaactcggaaaacttcttaccgctcttatcgcaccacctcttaatacctttgtattactgattattgcagcgattatttattgtgttcatttcaaaaaattagccaaatttattgcgattataagtttcacttggctttatatcatgagtgctccttttactggtttattgctaacaaataatgatgattctccagcccttaccctagatgaatataaacaagctcaagccatcgtcatattaggcggtggatcttaccaaaccaaagagctatatgcagaaacggcttctggcgcaccacaactagaacgtttacgttatgcggcatttttacaaaaggaaacgggcttgcctattttaaccacgggctattctttgataggcatttctgaaggcgatttaatggcaaaagaacttaaccaattctttaatgtgccaacacaatggatcgaaaataaagcccgtaatacggaagaaaatgccagtttcactaaaaatattttaattaaagatcatattcaaaaaattattttagtaacaaatcaatggcatatgaaacgagccaaatatctttttgaaaaacaaggatttgatgttcttcctgctgcagcggcaagctatggcagcaaaggaaatctatctgcaaaatcttttattcctgacttaggtgcattgaatagcaatatggttttattaaaagagtggattggttattggaaagcccattatgtagaataatttgcttataaaactcgatgacttgttgtttgaaaagaaaattgtatttgctcataaaaaaatctgcaccttagttagttgtttagtccaacttttggggtgcagatcaattcaaggcttttttattatattcaacattttatctataagaaaaaccgaatcccatagagattcggctttaattatgttgtgtttgaaaattattctttatgtattatgacttacgctaattccgcacgtaattttttggttacatccaccatcacttttaattggtcgatggtttctgtccagccacgcgtttttaaaccgcagtctgggtttacccataagcgttcttttggaattacatttaatgctttacgtaataaatgttctacttccgttgccgttggcacacgagggctgtgaatatcataaacacctgggccaatatcatttggatatttgaaatctgcaaatgccgttaataattccatatctgaacgtgaagtttcgatggtaatcacgtctgcatctaatgccgcaatggcaggtaagatgtcgttaaactcggaataacacatgtgagtgtgaatttgcgtatcatcttgcacgcccattgagcttaaacggaatgcttcgcctgcccattgtaagtatgcgtcccaatctgcacgtttaagcggtaaaccttcacgaatggctggttcgtcaatttgaatgactttaatgcctgctgcttctaaatctaacacttcatcagataatgctacgccgatttgtttacatacggttgaacgtggaatatcgttacgcacgaatgaccattgtaaaatagtcacagggcctgtgagcattcctttcattacacggttagttaaactttgtgcatattgagaccaacgtactgtcattggctcagggcgggtaacatcaccgtaaattactggtggttttacacagcgtgaaccgtagctttgtacccaaccaaatttagtgaatgcgaaaccatctaataattccccaaagtattccaccatgtcgttacgttctgcttcgccgtgaactaacacatctaaatctaattcttcttggcgacgtactacatattcgatctcttttttcattgccgcttcgtaatctgcaagagataactcgccttttttgaaacttgcacgtgcgtgacgaatttcagtagtttgtgggaatgaaccaatgtttgtagttggcagaagcggtaaatttaaccacgcattttgcttaacgatacgttctgcaaatggcgatttacgttgatccgcaccttttggcaagtttgctaaacgttctgccacttcagggcgatgaatttcttttgacgttgcgcgtgcatctgctgccacttggcttgcatctaatgcagcttgtacagacgctctgccattatttaacgcttgttttaatacgtttaattcttctactttttgtagcgtgaaagataaccagctgtaaagtgcggtatttttttcttttaattgtacttccacttctaaatcaaatggggtatgcaataatgaacagcttggtgcaatccataaacgctcacctaattttgcttttaatggctctaatacatctaacactttgtttaagtttgcacgccagatattacgaccttcaatcacaccagctgataacactttgctgtagtcttcaaatgccgcaagttgttctggtgcacgaactaaatctaaatgcaagcctgcaacaggtaaggcttttaataattcagcgtgttctgcaactgaaccaaaataagtggctaataataattttgcgttcactttgcttaattcagtgtaaacagatttataggcttcaacccattctgctggtaaatctaatgctaatgcaggttcatcaatttgaatccactctgccccttcagccactaatgcatttaatatttcaacataaacaggcactaattgatttaataaatcgaaacggttaaatgcttcgcctttttctttacctaaccataagaatgttaatgggccaacaatcacaggtttgaagtttaagcctaacgcttttgcttcacggatttggtttacataatgtgctggattagctttgaaagcggtcgatttttggaactcaggcacaagatagtgatagttcgtatcaaaccatttggtcatttcaattgcgaattgatctttgttaccacgtgcaagttggaaatattgatcaagggttaaattttggctatcaaaaccaaaacgagcaggaattgcccctgttgccacttgtaaatctaaaatatgatcgtagaacgtgaaatcgcccactgcaacgaaatccgcattcgccgctgcttgatgtttccagtttttttcacgcaacgctttcgctaaatctaataaatcttgctctgctaattctttacgccaataacgttcttgtgcgaattttaattcacgttttgcccctacacgaggaaagcctaaaatatgtgatgttgtcataataactccaatttaaagtaatttttttaatcatttagacggctaaacgtctataccaatatagaatgcttgatcttcatttattatgcaaacttattattttcaggatttacattaaataaattcataatcaagcattcttttatctatcaaataacgatgaatcaattcagctaacttatttccttaaaattaatctcgcttacgacttaataaccaccaaatcattacaatgaaaagcaagctcgggatcaatgcaccaaaaatagcaggaataccgtaaactacactcgtttgtcctaaaatttcattaacaacataaaataagaatcctacacaaatcccagtaactatccttgcacctgcagtcacactgcgtagcgagccaaaaataaaagataaggctaataacatcattacgccaacggatacaggctggaaaattttacgccaaaacgtgagttcaaaacgactcacatcttgccctgtttcacgcagaaatgaaatgtaatgatataaacctgagatagataatgatgtcggacgcaaagaaaccgcacctaatttatctggcgtcaaactagtttcccaagtttctgataaatgattcgttgtgatgatttcatctttcataatcgttgaatgattaacttgacgcaatgtccatttagcttcatcttcagaataactcgcctggtttgcatgttttaattttattaaattatgctgttgatcaaaggtataaatataaatatcgtctaattttgtatcatccgtcacacgcctaacaaatacaaaatgatgaccatctttcgcccacacaccatttttaattgaaagtattgaaccaccagaaagagccttagcgcgcgtatctcgtgcaaattgttctgtttgtggaattccccactccccaataatcattgtaaatactactaatggtaatgcagttttcattaccgctatacctattttaaagcgagaaaatccagctgattgcataataacaagttcgcttctgctagcaagattacctagtgcaattaatgccccaagcaatgctgccataggaaagaaagtttcaatatctttcggtatagttaaaccagtaaaaattaccgcttgccaaatatcataagtgcctttacctacactacgaaattgttcgacaaatttaataatcgccgacaatcccactaaagtcattaaagtagcaaaaatcgcgccaagaatactttttccaatataacgatcaagggtatttatcatcttttgccgatcctttcttactgaataaatagcgaaatttatacattatttcactgtcccagctattcaacaccacagcaagtaagaaaaatccgatattaacaagcggcattaagagttcagcctctaattttcccgctgaacctgcagatttaaaagagctttgtaacaagaaataaattaaatagagtaaaagtgcgggtaaaattttggcaaatctaccttgtcgaggatttacgcgacttaatggtacagcaatcaatgccattaatggcactgccaaaattaaggtaatacgccaatgcaattcagctttcgcagaagaagaatctaaatcgataagttgagacaatgttaattctgctacttcatcattggtattttctgcggattgataacctaaataggcgtgatattcatcaaaatgcgtaatgcgaaaatctggcaaagcggaggttccttcaacccgttttgtatttttcaaatttaagacttgatcaccatttggcaacgcaattaattcccctttttcagctgttatcactgaaggttttgtttgtttttgaggtgtcatttgaaataaataaacattgcggatttgattatctttaatcttatcaataaataacacaacgttattgttattggtagaaataaactgacctgaagacagcacgccaacggttggattagcctttgcatcttccaccatattcacttgtttttgaattgcccaaggcgaaagccataatgcgttataagcggcaatacctgccgttaataaagacataatcagtgccactttaaccaaaatccgttgccccacaccgcacgcgcgcatcactgtgatttcactttcagcgtaaaggcgaccaaaagtcagtaaaattgcaataaataaacatagtggcaacatcaactgcgccattgttggcattcccaagcctaataaagagaaaaccaaatcagctggcacattcccatttgccgccgcacctaatacacgcacaaactgctgactaaaaaaaatcaatagcaaaattagtaaaattgcgatttggcttttgaaaacttcttttattaaatatcgaattaaaatcatcttatttcgtttgtttttctaaatctaaaacggaggaaaactggataaaatcggtcgcatatgataacttattttcgctgaattaaacagaaatttaaggacaacaaatgaaatatcaagcaaaaaataccgcactttctcaagccactgattgcattgttttaggcgtctatgaaaataataaattttcaaaaagttttaatgaaatcgatcaattaacccaaggttatttaaacgatttagtcaaatcaggtgagctcactggcaaattagcccaaaccgttttacttcgtgatcttcaaggtttatctgctaaacgcctattaatcgttggctgtggcaaaaaaggagaactcacagagcgtcaatataaacaaatcatccaagctgtattaaagacactaaaagaaaccaacacgcgtgaagtcatttcttatttaactgaaattgaattaaaagatcgcgatctttattggaatatccgctttgccattgaaacgattgaacacaccaattatcaatttgatcatttcaaatctcaaaaagcagaaacctctgttttagaatctttcatcttcaatacggattgtgctcaagcacaacaagctatttctcacgccaatgccattagctcaggcataaaagcagcacgcgacatcgcaaatatgccaccaaatatttgtaatccagcttatcttgctgagcaagcaaaaaatttagcagaaaattctaccgcactttcattgaaagttgtggatgaagaagaaatggcaaaacttggaatgaacgcttatcttgccgtctcaaaaggctctgaaaaccgtgcttatatgtctgttttaacattcaataatgcgccagataaaaacgccaaacccattgtacttgtaggcaagggattaacctttgatgcaggcggtatttcacttaaacccgccgcagatatggatgaaatgaaatatgatatgtgcggtgcagcctctgtcttcggcacaatgaaaaccattgcacagttgaacttgccattaaacgttattggtgttttagcaggttgtgaaaatctgccagatggcaatgcttatcgcccaggcgatattcttaccactatgaatggtttaaccgtagaagttcttaatactgatgcagaaggtcgattagtgctttgtgatacccttacttatgttgagcgttttgaacctgagcttgttattgatgttgcaaccttgactggtgcttgtgtggttgcactagggcaacacaatagcggcttagtttctacagataacaatcttgccaatgcactactccaagccgcaacagaaaccactgacaaagcgtggcgtttaccattaagcgaagaatatcaagagcaacttaaatcgcctttcgccgaccttgccaacattggtggtcgctgggggggcgcaattacagcgggtgcatttttgtctaatttcacgaaaaaatatcgctgggcacatttagacatcgctggtacagcttggttacaaggtgcaaataaaggtgcaacaggtcgccctgtttcgctattaacccaatttttgattaatcaggttaaataaccacaaaactggcacacgttgcacctttaaatcgattactctgctagttcggtttgctcgtgtgccatcagttcctgacccacatcatcaagcaaacttagataacgttcatattgtttcaacatatcggcaatcaattcatcttgatccatatattgaacatcgtaaccgactcgtccatcaaaaaaataagtgtaaggctcgtaagtagcactatgctgaatgtgcggtagattttcatcgttaattaattgctctgacacttctcgcccaacagatttaataccatacataaaatctcgcattgattctttatgaattaccaattccaaagctggctcttcttgttcaaataatgtgttgatttctacacttaaattatattttcctgttaattcttgacgtaattctcgcatagcgggtaacgccgtatttttaaggaaacgtaaaatatctttctcttgcgtttggttcatcatttgctctaaatgtgatttccatttatcgccgctccagaagatactagttggattgactttagtagaaaaatattttttatccgcaattaagcctttccataaactaaaacacattaccaacatcaataaagcaaaaggcaaggcaacaattaatgtcattgtttgcaaattagcaagtccaccagattgcataagcacaatcgcaacaacggacattaaagttccccacattatggcttgccacgcaggcgaagctaaacttttatcacgagatgcaatgttatttaacacataaatacctgaatccgctgaagtgataaaaaacaataaaatcactaataagctcacaaagcctgttattgttggtaaaggcagataatttaaaaatttaaataataaaatttctggggaagaaataaattcgccaagcccgcccgcagcaatgccatcatttagccatactgctgtattaccaaaaacagtaaaccataaaataccaaataaacttggaataactaatacgccaaaaataaattcacggatagttcgccctttagaaatacgcgcaataaataaacccacaaacggagcccaagaacaccaccaagcccaataaagcacagtccatccgctaaaccagctagtatgttcttgttcataagcataggttttaaaactgagttgcactaaattgctgaaataattaccaatattgtcgctaaatgcagataaaaggtataacgtagggcctgaaattaaaacaaagagaagtaaacaaaatgctaaagttaagttaatttcacttaatattttcacgccttttccaacaccagaaatagcagaaaacaccgctaaacacatcaccacaacaataacgccaacttgtaaggcaaagctgttctgacttatccaacctatttgttcaagccctgcaccaagctgtgatgaaccaaaacctaatgtggtaataatcccaaataatgtggcaagtaacgccataacatcaattgcatcgccgattttgccattaatacgatcttttaataaaggataaaaacaagagcgcaacgctaaaggtaatttataacgaaacccaaaataagctaatgctaaagcaatggtgccatatactgcccacgcgtgaattccccagtggaacagagtatgaagtaaagcctcttgttgtttatgttctgcagaacctgctgtaatgtcagaaagataatgggttaatggttctgctacgccaaaaaacatcagcccaacccccattccagcggcaaataacatcgcaagccaagataagaaactaaattcaggttcttcttcatcttgccctagttttatattgccaagactacttactgataaaattaataaaaatcctaaaaacactgaaaaagtaagtacataaaaccaactaaaattagcaaaaataccacttttagcttgattcaataatgcttgagtttgctctggcgcaataaaaatcattgccatcagtaacaatataaaaaataacgtaacgccaattaccaaaggattaaatgacgttcgctttgtcataaattgagataaagacaaacttttccccttaacgattaaatgaatagattaaaaatagatttaataaacattgcctagaggcaaaaatgtgtaatggaaccactacaaaggacagcacatagaagtgcgattttgaaggaaacgttcagtaggaattgaaggattgtttccaaaaacttgtgcatattaacaaaatacagtcattatttcaaattagtgaaagctaaactaaaaaatgcggtaaaatttacaaaataatttaccgcacaaatatcatttattttaaagccatttctacaaggatattattgcttttaagccaattcttctcccctcttttacaacattttctaaccgcactttaaatccgtgtaattccgcaattcgcataacaatagaaagtcccaagccacttcccttttcattttgcccagctggacgataaaaacgctgtccaagttttttcaaatcttcaggttcaacgccaccaccattgtcctcaataataatctgtgaggatgaaatttttactgaaacgattgtatcttcaggacaatatttaatagcattgtcgagtaaatttctaagcatcaatgaaactaaaattgattgcccttgtttttgctttggttcagattctttctcaaaaaccaaggtaattttacgtttttctgccacaaaataacgctcagaaattaatgattgaacaatagcttcccaatcaagcagctgtagtgtttctaaggcttgcaaattatccaagcgggaaagcgttaataattgttcaatcaattgcgaagcccgatcaatgccttgcgttaaatgtaaaagtgcttgttctcgtaacgctacatcatcgccagctagttgcgcaacttcaatttgaatacgcaatgccgccaatggactacgcaattcgtgagctgcatcagaagtaaaacggcgttcgcgttgcaacatagctgaagtgcggtcaaaaaattgatttaaattttttactaagggtaaaatctcaacgggtagcccctccgtattcagcaatgacacatcgccagattttctcgtttgtacttcttggcttaaacgtttaatcggtcgaagttctttatgaatcaaccatcctaaaacaatgatcaaaataggcaaactggcaaaccaaatccacatttgccccaaaatcatttcttcaattaaatcttcacggtaatctaattcttgccctactgcgataactaattctccattagctgccatacgccaaaaaattcgccatttatcgtcatcatcataaatattcgcattataaaaccccgttttataattaaaaataaaatcttttccatttcgtccatcactgaataaaagtttcccagttttagaaaaaatagcaaaggctaaggcatcatcgtcataacttttttttaataccgactgtgaatttttatttagcgttgtgctagattccaacaaaatagtacttaaatctgaatttgcgagccgttcagcaaagagaacttgttgtgcatcaaaaactttattcacatcgtggcgaacttgccaccaagccacaagcgtagaacccagccaaacaaaaagtgcggttaaacaaagcacagaaataagacgcaacgtaaggcttctatttttcatttttcaacttgtcccaaagcatatccaacaccgtgtactgttcgaataaattgcttccccaatttttggcgtaaattataaatatgcacatccaatgcgccactactaatttcttcatcccaactggataatttttcttcaatggatgagcgagacaatacgcgatctttattcagcataaataattcaagcaatttatattcacggcttgttaaagaaatgggttgattattcagccaaacagaacgttgattctgatcgagcttaacaccagcctgttctatcacagaatgatgatatccataacgacgacgaataagggcttgtaaacgtgcggcgacttcagccaaagcaaaaggcttgcaaagataatcatctgcaccactttgtaaacctttaactcgttcatctaaagtatcgcgagcagtcaaaattaatacgggaacatcttgatgattagatcgccattgttgcaatacctctaatccatcaagtttaggcaaggttaaatccaataccaccgcatcataaggcgcagaggttaaagcagccattcctgtttttccatcagtaaaccaatccaccgcaaaaccaagtttggttaaaccaatctgcaacccattgccgattagattatcgtcttctatcaataaaattctcataaaaaattgaccgcactttataaacaaaaacagcgagctaatgctcgcattttcagaaatgattattctgctttttcgatacgtaatacatcaagctccgctttctcaaatacctcattatccaattttccataaattttcactttatccttagaatctacgtttaaaccattccaaacgcgttttttaatttcaatcttgatttgcccagtcccatcagtaaaccaaaactcatcgtcatcaatttgctgagtgatattccccactaaagtaatcattgaattatcagccgcagataaagcttgttttacactaattgcagcaggggctgcttgttgaaaaccaccttgactattattgccattaaaaccagcaaatgctgaagtggttgctaatgcgaagattgttgctaatgcaaattttttcataacgtttcctttttaagttagttaatttcaagctccattgcttggatgtgtgtattaaaacaaataaatcttaataaaagattaagaggactatacttttttgaaaagactttatcaaggcaattttgcgaccactgcatagccttcaattaatccttccacttcataagccgcacctgcagtaatgaaagctacctcaccttgtttcaaagaaagtgcggtcgtttctgaacgtaaatttaactgccctttcattactaataaaatactcgcactttgtgcttttaaatgatgtgtttcgccacattcatattgaatattttgcaaagcgaaatcttttgctgacgtggcgtaagtatacctacggttaattatagtcgttcctctttgaggaacttcaaactaccccaacggggtagcacttaaattagcctagggtatacttaccctaggtaactataataaataaaaaatccgcacaaaggcggactttttttaccgtaaacaaattatttctttaaggctaataccactgattctccagccactacttcgcctgatttttttacgatacaagaaatttcgtccatatttgaaattacgattggtgttaagacagattttgcttttgattctaatagcgcaagatcaaattcaatcacagtatcgccacgcttaacagattgcccttcttgtgcaatacgagtaaagccttccccctttaactcaacagtatcaataccaaagtgtacaaataattctacgccttcttttgattccattgaaaaagcgtgattggtttcaaaaattttaccaatcacaccatccactggcgcaacgattttgttaccaataggacgaacagcaacaccatcaccaacaattttttcagagaaaaccacatcgggaacatcttcaatattaacgatctcgccagagatgcgtgcataaatttcaacttccacagatttgttttcttttgaaccaaataacttgtcaaataagcccattttaatctcctatccattcaagatggttgctattttaacgtaaaatcaaataattttgtttaatttaatgaattttccagcaaaaattcttcaattaattgatcaatttctgcagcggtcggtttttgtaatgcagtatcagcaagcacttttgcatcttgaaaatttacattacggattaattttttaattcgaggtacagaaatcgcactcatactaaattcatctaatcccataccaagcaataataaagtcgcacgttcatcccctgctaattccccacacattcccgtccattttccttctgcgtgagaggcatcaatcacttgtttaattaaaccaagcacagaggggtgcatcggattataaagatgggaaataaactcattaccgcgatctacagccaaagtatattgagttaaatcgttagtaccgatactaaagaaatctacttcttttgctaaaaattttgcatttaccgcggcagagggggtttcgaccattacaccaacttggatattattatcaaacagtctcccctcttcacgtaattccgcttttaatgtttcaataaccgcttttaattcccgaatttcttctacagaaataatcatcgggaacatcaccgccaatttaccaaaagctgaagcacgtaacaccgcacgtaattgtgcatttaaaatttcacgacgatctaatgcaatgcgaatcgcacgccatcccaagaatggattcatttcttttggtaaatctaaatatgaaagctctttatcgccaccaatatccatagtacgaatcactgttaaacgtccgttcattgcttctaccacttgtttataggcaataaattgttcttcttctgtgggaagctgttcacgatccataaataagaattcagttcggtataacccaatcccttccgctccattacgttctgcgccgtcacaatcacgaatcgtcccgatattcgcaaccacatcaaccttatgtccatctaatgtgattgcaggaagatcttttaatttagctaactctgctttttcctcagaaattttcgcttcaagtgcttttaattcatcaatctgagatgctgttggattaatataaacttggttattgatagcatctaaaattaaataatcgcccgtattgactaatttagtcactttatttgtgccgacaatcgctggcaattctaaagaacgagccataatagaagtatgtgaggttctaccaccaatatcagtgacaacccctaatactttttcaagattaagttgagctgtttctgagggagtcagatcataagcaacaagaatagattcttcctgaatatcaccaagatcaacaatgtacattcccaaaatatttttaactaaacggttagcaatatcccgaatatcgcctgcacgttctttcaaatattcatcatcaatttcagataacattgtcacttgttgatctaaaattttactcgccgcaacgcctgcattcactttatttgaacgaagataatcaagaatttcttcttctaattcttcatcctcaagaatcatcaagtgaccttcaaagattgccgctttttcttcgcctaaagaaattaatgcacgttctctaattgaattaagttgttctaccgccgcgttacgcccttcataaaatcgagcgacttctgcgtcaatttgatcatcagtaattttttgtgtatcaagaacaatcttttcttctttaagaacaagtgccttaccaaaggcaatacctggagatgcgagaatgccagaaatcatagataccttccgaaacaattaacaaagtaataaataaacaatagccataaaatttcacaattttatggctaagtaagaattattctaaagttggaattaacgcgactaaatgttcaactgcctgttgctcgtcttctccatcagcagaaatggtaagtattgttccctgcgttaaagctaatgtttgcaacttaaataagctctttgcacttgcacttttccccccagaggttactgtaatttcagaagaaaatgctttcgcttctttcacaaattgtgcagcagggcgcgtgtgtaaaccgtttgacgcaataatttccacatcttttgaatacataatgctacctcgactaatcaataattaaaaatataaaaccagaaaattgccctagtatcctttttcaaagcaaaataatcaagaataaacactaaaaagcctgaattaaatcataaaaataagctaaatagtttatttattattcacaatctcaatcgttaaactaatgaaaaatgacgttgtgattttgtttcacttaaactttcaattaatcgatgatagttatcataacgaacaggcgaaattttgccttgctcaacggcttcacgcaacgcacatcctggatcgctcaaatgtttacaatcacggaatttacaggtgcccaaaacatattgaaattctcgatagccttttgtgatttgctctgcatctaaatgccaaagcccaaattctctaattccgggcgaatcaattaaattaccgccttgtggcaaatggtaaagacgtgacgatgtcgtggtatgctgacctaaccctgacgtttcgctcacatcccctacttgagcgtttacgctaggcaaaatatgattaattaaactcgatttaccaacaccagattgcccaacaaaaatcgccgtgccttgtgccaaaagtgcggtcaatttttccatattttcaccgctctttgctgaaatcattaaaatttcatagccaatatcttggtaaattttaagttggtcttcaatttcttgacgctgttcctgcgccagtaaatccactttattcaaaacaatgagaggcgtgattcccgcaatttcacacacaacaagataacgatcgataatatttaaggaaagcgttggcaatactgctgatacaataataatacgatcaatattcgccgcaataggtttcaaaccatcataataatcagggcgggaaatttcattttctcggggatggatcgcctcaattacgccgctcacaccttgtaattgttcattgcctttacgccaaacaactttatctcccaccaccaaactcgacaaggtacgacgcaaattacaacgataaatttcgccttgttcattttcgacatctgcatgaatcgaataacgcgtgacaacaacgccttcttgcgattcacccagcatttcatctgaccattcaatctcttttttcttatggcgatgtaatgttttcgcattatttgattgaattcttcgagtttggttttgagttaatttacgtttagccataaaagtgcggtcgttttttcccttgtttttggtaaaatgaaaaaaatttttgcataggatacctgatattatgtcattcgataaacaaaatcttatttggattgatttagaaatgaccggtttagatccggaaaaagaacgtattattgaaattgcgactattgtgacagataaaaatttgaatattttggcagagggcccagtattagcggttcatcagtctgatgaattactcaataaaatgaatgattggtgccaaaaaacgcatagtgaaaacggcttaattgaacgcataaaagccagtaaacttaccgaacgagcagcagaattacaaaccttagactttttaaaaaagtgggttcccaaaggtgcgtcgccaatttgtggtaacagcattgcccaagataaacgcttcttagtgaaatatatgccagatttagccgattattttcattatcgccatttagacgtgagcacattaaaagaacttgctgcacgttggaaacctgaaattttagaaggttttaaaaaagagaatacgcatttagcgctagatgacattcgagaatccattaaagagctggcttattatcgcgaacacttcatgaaattagattgacgaaaacttcaacaaaaaatttctttttatgaaattgcccttgcaagccctaaaaatatttgtataatgtgggctcattcactgatgtgaactgcgggaatagctcagttggtagagcacgaccttgccaaggtcggggtcgcgagttcgagtctcgtttcccgctccaaatttcaatccctagccaaaaggctggggatttttctatctacaaaaatagatcaccaaaatcttaaaaagtgcggtgaattttctcaaaaaataaaggcttgtgatttaataacacaagcctttatttttttatgctttcttcaaccgtttggcacgacgtttcattcttcttacccaacgggtaattcgccatgcatgcgtaattgaatagacataaaggaaaaataaaatgaaaaagccaacaaacatcgcccactcattcacataataaacttcccctaaaataccgatagttgcacaaactgcagaaacaaacgtaatcaataaaaaggcttgtcttgatgttaaacccgctcttaccattaaatgatgaacatgtaaacgatctggacggaatgggcttttacctttacgtacacggcgataaataatcgcaaccatatcaatcaaaggaatcgcaataatccaaagtgcggttactggattcataggatgcccttttccttgcgtacttaataacaaaatccaaataatggtaaagccaattaatgtactcccggcatcccccataaacaccttatattttggtccaaatggaatccctagattgagcatcaaataaggtaaaatcgatacgattaaagcaaaactccaatgcgccatatccatttgcccatctcgatacattaaaataccaatcgccgcaaaagaaacacaagagagtcccccaagcaatccatcaataccatcaatcatattaaaggcattaataatcgcaatagtggcaaagacggtaataatcaaaccaattgaaccaagcgttaattggaaaggccctaaaatttgaccaagatgatcaagataaatattcccaagatcgatcattaaaatcgccaatattgcttgaatgcctgctcttaaaaaagggctaatatcaaagcgatcatctaaaatcccaatcgccaataaaacaaaaatactgaacaaataaagatacggtaatcgaagttgatcccattccatcagataatagcaaagattaccaacaaaaagcgatgcgccaccgattagtggaattgtgccttgatgacgtttacgatagtttggtttatcgactaatccaatccaattggcaagtggtcgcatcacaatcaatgttaaaaacgcgccaagaaaagtaacaaaaatactcagcatagtgtgaccctaaaattttttgtaaaggataacataaggcaaatttacctagaaatatatttttaacgaagccctatttttcacttcaacgcccgtatttttataaaaaatgcggtcaaaattgaccgcacttttacgcctatcttttattttaccagtggtatcctacactccccccccattcacatcacttcggctaaatagatttctgatctttgcggatttgcactttcaagctatcgtgttcagtacgaagctgttgtaactctactttactcgctccttcccctaacatctcaacaaattcagtttctgatttaccttgattagctgacaatgctttccaactttcatgagcagattttcctcgttctccttgtccgccttgttcgccttgttcgccttgttcgccttgttcgccttttaattcaggccatttgcttaatggtttctttatctaatgaaacaacggtttttccatttttttcttttgttttcaagccatcttcaaaagtataaagttgtttcaaaagcattttaaagttatcttctgtaaaaatggttttatcgccagcttttaaaacaccattatcagcagtaagtgaaactgttttcgctttagcaccatttcctaatactaaagcccctgcagaagttgtcgctgaagcgtgatcgccaccaacaaaagcactatcggaatctgtcacgctagttctattccctaaagctaccgtactgtttgatcttattgattctgtcttacttcccaatacaatcacatctttggaattttctgcttttgctgcgaaatcagtaacaatagaaatatttgaattcgttgcattagcttcaacaccttgaacaattgctttttctgatttttctacttttgcattagttcctgcggctaaactatactcagaattaagaaccttagcattctttcctaaggctattgagtacggagattctgttacattagcatttgcccccacagctattgatgcggcaggattatcaggtgtcttatcctttgggtgtgtatatttcgtatctgaatctttaactaacgcattatgcccaatagcaatacttaaccgagaattctcaattttagcgtcattattttgagctgttccactagctgttaaatcagtatcattggtaatttttacatattttgttaaatcactttcttccctatttatttccattcattaaaaagaaacctttgttttgttgttttatatttttaataaaatagagatatttacctaatttgctgaataataacactgttcaatctttccctctcctctcttgcaagagcttgcccaaattgattcgtcaaaataaaaaagtcctcggctttttcgcctacggtggtaattttcgcatttaataaatttagatttaactcagtaaaaatctggctcacttgggctaataaccctgctttatccaaggcaaccagttccatttcagtatgttcttttttgttttcctgtaaaaaacgcacgtcggtttgtacagtaaaatgttgaagctggcgattaggcacaatagaaagtgcgggtaatttttcactttgaagagctactgttagggcttgctctagttctcggcgacgatcaaattcaaccaattctccgttaagttctgtgatgataaagctatcaaaaacataaccatcttgtgtcgtaataatctgcgcatcgtggatactgaattttttggcgccaatggtactcaccactttattaaataagtgcggttgatcttggcaataaataaacacttccgtgccgccaagtgaaaagcgattactaattttcactaataatgcctcaacgaaatccaccagcaaacttgtatgccaggcgatttgctttggcgtattacgcacaaaataatcttctggacaacgagtccataatttctcaatagagattgacgtaatatcagaataatcctgcgttaaaatttgttgtgcaagttttcggttttctgccgatttttctgagtaatcaagcaattctttcatgccttgtgaaaattgctgttcagtaaattcatataaagaggcaaaaagcgaacgtttccagctattccataaattaccattggttgcacaaatatccgccaccgttaaacaggtcagataatctaatcgaacttgattttgcatggcttccgcaaaattcattacgacttcaggatcatgaatatcacggcgttgcgccgtaattgacatcagcaaatgggattgaactagccaagcaagggtatcaatttctcgacgatctaaaccatgtaattgcgcaaagtctgccacatcttctgcgccaagttctgcgtgatcaccgcctcgcccttttgcaatatcgtggaacaacgccgcaatataaagtaaagtgcggtcagaaagttggctaaaaattcgatgagcaatgggatgttcttgagcacttccctttggcagaaaactttccaatttcaacatcacgcgcaatgtatgttcatccaccgtataaatgtggaacaaatcaaattgcattaatccctcaatggcttgccattgcggaagataagctgttaatacaccatattggtgcatcggcataaacgcacgcttaatcgcattagattgattaaacaaacgtagaaatttttctcgagctgcaggaatttcgcataatttttgtgataattgctctaaggaaatttgtaattgacgcaaagtatcagaatgaatattgacatgttcgtactgcgttaaataaaagaatagatctaaaattcgcgctggtttttcttgaaaaacaaagctattacgcaaacataaggattggttaatcagttgaaaatcatcgtctaattggtcaatcacagtatcctgatttgatgaaagcacattttctcgataatgctgaatcaacaaattactaataagcgaaattcggtgcaatgcttggaaaaaacatttcatcattttttccacagctggattgccttcccctcgaaagcccaacaattcactaactttaatttggcgatcaaacaacagacgattatcgtaacgtttcaaaatcaaatgcaaagcgaaccgcactttaaataaaaatgcacgactttcttgtagttgctgatattcttgaggataaataaaaccactttgtaaaatagcctcaagggtcaaagccccagaatggcgcaacgccacccaatacaacaaatgcaaatcacgcaaaccaccagggctgaacttaatatctggctcaaggttataagccgtattgtgataacgctgataacgttctatttgctcttgcactttggcattaaaaaaatcctctttcgaccaaaaatctgcacgttttaccaattcatttagtacatcaaagtgcggtcgatttccagtgagaaatcttgcttctaataaattggtggcaatcgtaatatcttgttttccttccaattcgcattgttctaaggttcgaacactatttcccacctcaaagccacaatcccataaaaattggataaattgagtaattttttcttcaatctcatggcttggggtttgctcaactaaaatcaaaaaatctaaatccgacaaaggaaacatctcacgccgtccataaccgcccaccgcaattaaagaaatgccttgctgttcacttaatcctatttcctgccaaagttgaatcaataaggcatcataaaaatcacagcgattttcaataagctcaaaaatggaataacaagaaaaattctctagctcaaattgcttgagattttctcgttcaattttgaccgcacttggcgttaaaagagaagatagtgtcggagaaaacagcatatgaattgccttttgttagatcgaagtcgttttattataaagaaaaacaaaaagggcgtatatgatctgcaccccaaaagttggactaaataaccaactaactaaggtgcagttttttatgaccaaatacaattttcttttcaagcaacaagtcatcgaattttatcttcaaaatgataaaaatagttcacttacccgcaggcattttcaacttgccgaaacaacattagaacgttggattaaccaatttaatcatagtggaatcaatgggctagccttgctgggtaagaagcgaaattactcacctgaatttaaacttaacgtgatacaagcggttaaaaatgggaaattttctgcagaagccgcttgcttacattttggcattgccaattcaggtgttgttagccaatggttgcaagcctttgaaaaacaaggtataaacggcttaatccccaaacctaaaggtcgcccaaccatgaaactccaatatcctaaaatgccgcctaaaccgaaaacacgagaggaagaactagaattggaaaatctccgactacgtgcggagaatgccattctaaaaaagttgcaagagctcaaccaacaaaaaatgcagaaaaagccgctatcgtaaaggcattacgcgttcattttccgctgcccattttattagatttaatcggcttggcacgcagtgttttcttctatcacttgaagacgaaaaacgataaaaatgcagcactctcacaagaaatcgcctctatttatcacgataatcacggaaactatggttatcgccgtgtgacgtttaagctaagagaaaccattaaaattaaccataaaaaagtgcaacgtattatgcaatggttggggcttaagggaaaatgcaagacacaaaaatatcgttcttatcaaggtgaagtcgggcatattgcggataatctgttacaacgcgattttacggcaacacagcctaatgaaaaatggacaaccgatattaccgagttcaagtgtgcggaaggcaagctctatttatccccaattaaggatttatttaacaatgaaattattgcttatgatttagcgcgaagcccgaactttgagcaaattaccagaatgatgaaacaagctgtagcaaggcttgaaggcgcaaaaccgattttacattccgaccaaggttggcagtatcagatgataggttatcaaaacatactcagggagaatggcattcaacaaagtatgtcaaggaaggggaattgtttatataacagtgcgatggaaagcttctttgggagattaaaaacggaatgttattacggcaaacgatttgaaacgttcgaacaactggaaaaaacgattcatgaatatattcattattacaaccatgaacgcattcaggggaaactaaaaggactcagccctgtgaattacagaactcagtccttgaactaaatcagtctaactttttggggtcagatcaatatctacgcccttatcttataattttatgccaattacacattcaccataatccgcgaaattcgaccttctgcaatttcttcatcgcgaatagtcattacttcacaaccagtttccgtgacaataagttgatgttcatattgtgctgaatggctgcgatctttggtttttactgtccaaccatctcccattacgcgcacttcttttttgcctgcgttaatcattggctcaatggtaaacaccattccgggttttaaaatcacgccgccatcatcggcataataatgcaatacttgaggttcgcagtgaaattccgtaccaacgccgtgtccgcaatattcacgcacaacgctgaaagtctggctttccgtatatttttgcacggctttacctatttcatttaaacgaatatcgggttttacagtgcgtatcccaacatataatgcttcttgtgccgcttccactaattttttactacgaatatttgtttctccgcccacgatatacatttttgagttatcgccaaaataaccgtctttaatcacggtaacatcaatattcacaatatcgccattttttaacactttatcgtcacttggaataccgtggcagacaacttcgttaatggaaatacaggtcgcctttgggaaaccgtgataattcaaacaagcagggataaccttttgttcatttaccatatattcatggcaaatgcgatcaagttcgcctgtggttacgcctgcttttacgtaaggttcaatcattaccagcacatcggaagccaatttgcatgcctcacgtaactttacaatttctttttcagttctaattggaatagccatttttatctcacttttttgaaaaaactttacgagattatagcacgatttctaggaaaaaactggattgcacttgaatggagtaaagggttattagataatggcgggattgaaattttaggaaagtaggaaatagttatgatagatgatatggcggtgccactgacatttactgatgcagcggcaaataaagtaaaaagtttaatcagcgaagaagaaaatactgatttgaaattacgcgtgtatatcacagggggtggttgcagcggtttccaatatggttttacctttgatgaaaaagtcaatgacggcgatttaaccattgaaaaatcaggggttcaacttgtgattgacccgatgagcttacaatatttaatcggcggtacagtcgattacacagaaggtttagagggttcacgttttactgtaaataatccaaatgctaccagcacttgtggctgtggttcatcctttagtatctaagatggattttcaatttacacattatcaaggcaatgtatccgtcaaatgttcgatggaacacattgcccttgctaactggttcaacacagaagtgcggtcaaattcagacaagattttaaccgcactttctactgcaaaatcacttattgaaaatcaagaaaaagtcttaattggcacggaatatacgttatttttaaatgctgatgaagtaatggtgcgagccaacaatctcgccattgaatcagatgaaattttagaacaagatttccattattatgacgaagaaagccttgctttttgcggtacgcaagattttattcattttctccaatcttatgttgattttattgcttaactcactatgacttctcaacactccgctaaaaaatcatcgaaaaacacgccaaaaaataaccgcacttttaaaggttttttacttaaatttagcttcactgcacttgtcttaacgattttttacggcggttatctcgattggcaaattcgttctaaaatggacggtcaaatttggcatttgcctgcggaagtttatagtcgattagaaagtgtgaaaattgccgataatctcgcttttgatgaagtcattcaaattttattagataacgaatatcgccaaacgaccatggttgccgcccctggcgatttcaaattagaagatgatagcattgtagtgcttcgccgcgcttttcctttccccgataaagcagagcctcagcgagttttgcgcttgcgttttagccataataagttatctcgcattgaagatttagtgacggtcaaaactgttgatgaatttcgtcttgcaccaaagttgattgcgatgttgcaatcagacaacgaagatcgccttgctattcctttacaaaattatccccgtttattaattgatacattaattttaacggaagatcgccgcttttatgaacataatggcattaatccagtggggattttacgtgcattaattgcgaatattcgtgctggtcaaacggtacagggcggaagtacgctcactcaacaattagtcaaaaatttatttttatcgcgcgaacgcaccattacacgcaaagccaacgaagccttgatgtcattggttttagattggcgttacgataaaaaccgaattctcgaaacctatctcaatgaaatttatctcgggcaaaatggcgatacgcaaattcacggttttgaattagccagccaattttattttggtcgttcgattcgtgaaattagcttagatcaaattgcccttttagtggggatggtcaaaggcccttcactttataatccgtggcgtaatccacaaaacgcactcgaacgtcgcaacattgttttaaggctaatgcttgaacataaaatgatcggcgatgaactttatcaattattaagtcagcgacctttaggtgtgcaaaagaaagggcaaatctcgcgtaaataccctgcatttattcaaactttacaagcagatttacgccgtaagctgggcgaacacaaaatatcgagcttacttggcgcacgtattttttccacaatggatttaaaacaacaagctcaagcagaaaatgcagtgggcaataccgtttcgcaattacaactgaaaatgaaaaatccccatttagagggagcgatgattataacggattatcgcacaggcgaaattcgtgcagtagttggcggtttacaaacgcaatatgcaggctttaatcgtgcattaatggcaaaacgtcagattggttctttagtaaaaccttctatttatttgaccgcactttctaacccagaacagttccgtttgaataccccaattaataaccaaccaataacaattaatgtcaaaggtagcccgccgtggcagccacgcaactatgacaaaaaatatagtgattctgtaatgttaatggatgccttagcccgttctttaaatattcccactgtaaatattggtatgaaagttggcttgagcaaagtcattgacacgcaaaaagcgatgggctgggacaacgtggaaattcctaaagtgcctgcgatgttgctcggttcttataccatctcgccttatgatgtcacaaaactttatcaaacccttgccaatcaaggtgggagaattgcgcttacaaccgtcgatagtattgcagatcgtcaaggtaacctaatttttcaacacgataaaagtgcaaaacaagtggtgccacaagaagcggcattccaaaccttatttgcaatgcaacaaactgttgaacgtggtacagctcgcagtttgcaaaaggattacgctgatttacatttagcaggcaaaacaggcacaaccaatgaatcacgcgatacgtggtttgtgggaattgacggaaaaaatatcagcaccgtctggcttggtcgcgatgataatggcgaaacaaaactgactggtgcttctggcgcattgcaaatttataaagattatttaaaccgtacaaatattgaaaaattagcaattactccccctacaacagtgaaatgggtggggataaatcaatacggtgactgggattgtgagagttatcgaacaattcctatttggctaaataatggtcagaatttctgtggcgaaacatcatctccctctctcacgccaacaactgaaacagaaacaccaccacaagaaagcctgtgggacgtattggataatcccaatccacccgctcaataattaagccgtaggatttactaaatttccaataataaacattttccccctatacttcccctaacatttcagaggatttttatttctttttaaaaaatagcaaacgtttgctttatttgatttaaaagtgcggtacaatacgcgccagtttttactttcatacaggtgcaaaacgatgacacaacaactccccattttaagtctaaaaaaaatctattcaggcaaagtacgcgatctctatgaaatcgatgataaacgcatgctaatggttacttctgaccgcttatctgcctttgatgttattttagatgatcccattccacgaaaaggcgaaatcctaactcaaatttccaatttttggtttaataaacttgctcacattatgcccaatcatttcactggcgacagcgtttatgatgtgttaccaaaagaagaagcggatttaatcagagatcgcgccgtcgtatgtaaacgtttgaatcccattaaaattgaatctatcgtacgtggttatttaactggcagtggtttaaaagattacaaacaaactggcacgatttgcggattaaaattgcctgaaggcttggtggaagcgagtaaattacccgaagctattttcacgccatcaagcaaagaagaagttggcaaccacgatataaatattagctatgccgaatgcgaaaaacttatcggggctgatttagccgcacaagtaaaagaaaaagctatcgcactttataccgtggctgcagaatatgcactcactaaagggattattatttgtgacacaaaatttgaatttggtttagatgaaaatggcacgctcactttaatggacgaagtattaacgccagattctagccgtttttggtctgtggatacttaccaagcaggaacaaatcccccatcattcgataaacaatttgtgcgcgattggttagaaaatagcggctggaataaacaagctcccgcaccaaaagtgccagaaaatattattcagaaaaccgttgataaatatcaagaggcactggatttattaacaaaatgaaaattaggattttttatgcacaaagctaaataaagatttttgcttttaatgcacaaaacactagacaaagaggaaaagtgcggttatactctatagaatttttattcacaaaaatcgattatttattcaattctaattattagtaaggaaaatatatgtcaaatactattctacagaatttacctaaaggacaaaaagtagggatcgctttctctggtggtttagacactagtgcagcattactttggatgcgtcaaaaaggcgcagtgccttatgcttacaccgctaatttagggcaacccgatgaagatgattacaacgcaatccctaaaaaagccatggcgtatggtgctgaaaatgctcgcttaattgattgtcgtgctcagcttgctcacgagggaattgccgcaattcaatgtggtgcattccatatttctacaggcggaattccttatttcaacacgactccacttggtcgcgcagtaacaggcacaatgctcgttgcagcaatgaaagaagatgatgtaaacatttggggcgacggctccactttcaaagggaatgatattgaacgtttctatcgttatggtttattaacgaacccgaatttaaaaatctataaaccttggttagatgtacaatttattgaagaacttggcggtcgtttagaaatgtctcaatttcttattgaaaatggttttgactataaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcacagtcacttttgaagatggcgtacctgtggcattaaatggcaaacattttgataatgctgttgatcttattctagaagccaatcgtattggtgggcgtcatggtttaggaatgtcagaccaaatcgaaaatcgtattattgaagccaaatctcgtggtatttatgaagcaccaggaatggcattattgcatatcgcttacgaacgtttagtcacaggtattcacaatgaagataccatcgaacaatatcgtattaatggcattcgcttaggtcgtttgttatatcaaggtcgttggtttgatccgcaagcattaatgttgcgtgaaacagcacaacgttgggtggcaaaagcaattacaggcacagtaacgcttgaacttcgtcgtggtaacgacttcacaattttaaataccgaatcgccaaacttaacctacgaagcagagcgtttaagtatggaaaaagtggaagatgcaccatttgatcctattgatcgtatcggtcaattaacaatgcgtaatttagatgtatcagacacccgaggtaaacttggcatctatgcacaaacaggtttattaagcgcaattaaagattccgtattgccacaattaggcaaaaaataaataataaaatctgcatttcaatgactgatatttaacatcatgaaatgcagatcctttcacaaaatattagttagctaaaaaaactagagatataagaaataatcgtttttccacttaatattgccataataatcacaacaaaccagcctgaaaaagctaaaaaaacagggtgtttataagtgccaacaatatcacttctgtaagcagctaacaaaattaatgccaatgcaattggcaatattaagccatttaatgttcccacaaagactaataccgcagcaggttttcctacagtgactaaaacaacagtagaaatcacaataaaagcaataatccaacgattacgattgcgttcaatggttggacaaagggtcgttaagaaagaaactgaagtataagccgcaccaataacagatgtgacagacgctgcccaaataaccactccaaataatacttgaccaaaattgcctgctacatattcaaaaggcgtttcagctggatttttaggattaagagacacaccttttgacaccacaccaagcaccgcaagaaataatacaacacgcattgttgaagcaattaaaatggctgaaacagaactacggctcacttcagccattgctttttcgccttgaatgcccgcatctaataaacgatgcgcgcctgcaaaagtaatataaccgcctacggttccccccactaatgtaacaatagcaataggatcaatttgttctggaataaaggaatgatacgctgcttcaaccacaggtggttcagttttaaacattacataaaatgtgagcacaaccataataaagcccattaattgcgcaaaacgatccattaataagcctgcttctttacgcaaaaaaatcaaaatagcaataataccactaatcactgcgcccatttctggtgctataccaaaaatagaatttaaaccaagccccgcgccgccaacattgccaatgttaaaagccagcccgcccatcacaatcagcgcagcaagaaaataccctgctttcggaaaaaccgcattagaaatatcttgcgcgcgtttgccagacacaataacaattcgccaaatattaagttgagccccaatatctaacaaaattgataataaaataacaaagccaaaacttgctaataaagtatttgtaaaggttgcggtttgagttaaaaatccagggcctatggcggatgtcgccattaagaaagcagcccctaaaaccgcatttcgtctgtgagtaattgatgccataaagcacctccattgttaagttgatgttatgtgtttattcggcttatgccgttattttgatatgatttttttctaattcttccacaatgcgtttagcaaattgtaaagaatgttgattatcgccgtgtaagcaaatactttctgcttttacaggcacaaggcttccatcaatggcattgacttgcccctttgttaccatttgtaacacttgttgaatggcttccttatcagattccaccattgcatttggttgagaacgaggcaccaaactcccatcaggcatataatgtcgatcggcaaaaacttcagaaatcgtttgcaatttttcttcctctgcgatgcgcaacattaaactgcctgctaaccccattaatttcaaattcggatcaaattgataaacggtttgtgcaattaaacgcgctattttttcatcttttgctgcttggttatataacgcaccgtgaggtttaacataactaattaccgccccctcgccatcacaaatcgcttttaatgcccccaattgataacgcaaatgtgcgattaattcctgtgaagacaacgccattgccgtacgaccaaaattttcgcgatcaggaaaactaggatgcgcaccaatacgcaccttattttctttcgcaaatttgaccgcactttgcatttcctttgcacccccagcgtgtaagccacaggcaacatttgcagaagaaagcaactgcaataaactttcatcaaaaggaaaaccctctgcaatatctgcatttaaatcaatttttttcatcaacaattctcctaatttgatcaaggtatatttcatttttacggcgtaatttagcagcctcttgtaagctaaccgcttcaaatttaatcgttgaacctaaacgtacctgtgccaaagccccaagatcagcatcaatcacattagcgattttaggataaccgcctgtggtttgcgcatcagccatcaaaataataggctgaccacttggtggaacttgcacgctaccaaactgaatggcgtgagatagcatttccaacggctgctttaattctaatgtctgaccttgaaaacgataacccatacgatcactgttactttgcaacgtccattcatttcgccaccaataatattgggattttcgtttaaacgcctgatattcagaagatggcaaagcacgaataacatctcgaagcggaatcggcgcaataccaatttcgctacgcaaaatatgatcatttgccgtttgtagttgatcgcccgcctgcaaacaacgcccctcaatgccccctatttgcgctctcaaatccgtgctgcaagaattcaatgcttgaggcaaaacaaaaccgccttgaacacataaataaccatacattccaatttttgcacgtgccatttttaatatttgacctgctcgcacttgataacgccaataagcaaaaacgggcttatcatctaacatcatttcataaaaagcaccagtcacacaaaaattcatatcttgctgaaattgcaatgtaataccgcctaaaggcacttcaatggcaggaacattctctgcattgcccaataaaatattgcctgcgcgtaatgctaatttatccattgccccacaatggctaatgccaaatcggcgtaaaccaaaacgccctaaatcttgaatggtcgcacgggatttcacatcaagaatatcaatcatagttcaattccctccacaataaatttcacagtatcgccagcttgtaataaagttggttgtgcttgatttttatcaaaaagtgcttgtttagtataaccgatcaactgccacccacctggcgaagnaaaaggataaatccccgtttgcgcccccccaataccaacagaaccagcaggaacaaccgttcttggcgtggcacgacgcggcgtgtgtaaattttcaggtaaaccacccaaataaggaaagcccgcttggaagccaatcatatacacagtataaataggctcactgtgcatctgaataatccgctctggtgttgtctgatgaaatttcgctacatcagataaatcctgacctcgctctcccccataaataacaggaatttcaatatgacgcccttgaaaatccgatactttcaactcagcccaaagttgttctaaacgttgcacaagcggcttaaaatccacgaaaaaatcggtaaaaaccgtaagattattcattcccaagacaacttctacaatatcttgttctgattgcaattgacgagcaaacgcccataattggcgttgttgttgaatggaagctgggggtggcaaagagcaaaccaccgccgattcactgatcggaacgatattcataagataccctttatatgatgttatgtgatttgttatttttttgttacagctctcttttaaaggatatttatagattttgtcaagtctttattttcatctttttaattcaatttaaaaacattacgctttaaccatcaaaaggaaatttaacacaaattcatttggttgaaacaataataccacccataaaaaaagcggcaaatgccgctttttaaaagagataatccaaactttaccactggtaaccaacaccagctgcaacgcctgttttaccttgactattggttgtgcctgacaagcgaataatcactttgccattatcggaaattcttgataccccgatagctaaaccactttgaccttgataactacttcccgcaatagaaaccattgatttacctggcatagaggcttgtggtaactgtgaagccgctaatgcacttgctgtacctgcatctgcacgtttgcccactttattcacttgtccagcaaggtttgttaccccttttgccacggcatacaactggctgccgttaatcgcatctgtggaagtagcggaaatttcgcctgccgcgacgtttttaactgctttattacccgccctaatgccgtctgaagccactttaatcttgtcggcatcagtcgccgccgcaccattcgcaccgtttgccggcgtaaaggtcaagccgtctttggtaatcttcgtgcttgcaccgtttgcaccattctccgtgtctttaaactccacgctctttacgcccgtcaattcatctctgagcacgtaagtgaagtttgtaccctcttgtttgaccttcagattatcgccggctttcaaagttactttatcgcccgacttcactaaagtgtcggtatgcgtgccatcggtcgctcctgtgccgtctttaccaacgcccactttccagcccaatttgttcaggctgtcaaccaattcagaagcctcaaccaaaccggtagttgttttcgcgccgtcttgaatcgtagccttaccatcatcgccaacctgcaccgaaccttttttcggcgtaaaggtaaccgtgtcattttctgctttgatattcaacaactcgccgtctgtggatttaaatttaaaattcaaaccattgcttaaagtttgagttcccttgccgccgtcggcatcgctaccgccattggcataagcattgctcgcacttaacgtaacctgtttgtcttgcaaggctttcaactgcttaaagctgaccgcatcggtatcttccgtgccgtccgcaacattgctgattttcaccggatttgtaccgtttgccgataccaatttcactttagttttcgccagcttgccattttcgacttttttatccatatccgccgaaccgtcttgcttggcttcgtaatactcattgcccactttcacaacggttttgctgtcttccgtaacatattggaccggcaagcctgttacatccacacggacggttgtttttttgttatcatcagtcgtaacgctcacatttgcgtttgcgccgctggcaaattcaacagtgtcataagttgaaacaaaatcaacattatcgactgtaccgccaatcgtttttgcgccacgaatattccaacccgcattcaatacatcgcccacgctcgcagcacggttacgttctgtatcgctgatttcttttgtaaggtgtgctgtttttccacccacacgaggatcatctaaagtcgaagcaataccgtttaagtgaacattaccgttttgaccattcgtacccggtttcgcaaatttcaagccgtttgtatcactggtaatatcgactttattgccgtttgcaccaatcgttaaacgatcactaaaggtcgcagttttcgcttcaaggtttttcgccaagtcaaaagtaatattttttccatcacgtttaactttcaggtttttacctgctttaaaggttaaggtatcgcctgctttaagtgcgtcatctccctgatctttcgcatcagcttcatcaagtgcggtagttaaattctctgttttcacaaaagtcgccgcactattaattgcggttgcaacatcttttacagttgcgactttcttatcagcgtcattagcagtagcatcttttacagttactttaccgcgatctgcatcagtcgctccagttttaacagtttcaaagccacctttagtgacagcagtaccattattaccaacagttaaaacattatcagtgttttgattatccactttgagcttaatagtatcgccatctttttcaagaccgctatccgctttagtttcaaccacactaacggtaatcgtatgtttaccgttttcagatttggaagtaaccgtagcagcaccggctccggtaaagaggacttcatcagcttgtttaacttgattgctttcttctttcgtaccgtttttggttgatactacccaacccaatttacgtaaatcgcctacagtcgccgccgtgctgtcagccaccaacggttgtttatttgcatttttttcatttagatttaataaacctttataagcatcttcaacgtgtctatttaaatcagttgcagagttatttaaaacatcaaaattcgcatcgtcataagctcttaaaccactcgcaacattagtaatagctttattacctgctttaatgccatctttggttacgctgatggtgtttgtacctgtcgtaccgccattacctgctggcgtgatggttaaaccgtctttgttgatgacggttttcgcatcatttccgccattagttgtaccacctaaagtaatgctcgttaaacccgttaaagcatcttgcagtgaataagtaaagttcgcaccatcctgtttcacttttaagttcttgcccgctttaaaggttaccgtttcgcctgctttgacttcttggtcttttgaagtaccctcaagcgcaccatcagtatcagcctcagcttttgctttccaacttagattacctaaagctgttaccaaatcgcctgcattaacaagttttttcttgtcatcttctttagcaatttcagctaccttaccacctgtcacagtaagtgcggtcgtatctgcaacgattttttggtcgccgtcaatcttcaagccgtcgccaacttttgcttcgtatttaacagtaatgccatcagtactattagtcactgacgccgttgtaccattaccattagcaaaggttacatttgtacctgacgcaacagttgcgaagtcgtcattttgaccattagcagtggttgttttaactctccaaccgctcttattcactgcttcaatcacagtttttgcagtgactaagccattgcctcgtctgtatcttcagttgcattggtcgctgtaccagtattcgcatccttcaactgcttacctgtaagcaacttaccattattatctttaataacagaagttttcggtgtgaacttcacttcggttgttttaccgttttctttagctgttaatacaacatcaagtgtgtttttatctcctgtaataaactcaacattgtcataacccgccactaaatcaacattctcggtattaccccccgcaactttagctcctttaatattccaacctgcatttaaaacatctttaatagttgcagctcttgttttttcaatgtcactaggcgaaaaggttactgaagttgaggcacctgtatttgtagtcacatcaggcaaagttgaagccaagccattcaaatgaactgcagtatctccattagtgccttttgctaacttcaagccatcagccgtgctagtaatacttacttttggcgtagcaccacccgcagcaggcgtattcccgccaatcgttaaagtatcactcactttcgcggttttcacatcaaggtctttcgctaaagcaaaggttactgatttaccaccttggtctaacttagcttttaagtttttacccgcttttaaggttaaggtgtcgcctgctttgagagcttggtttttattgtcatctttggttgcagcactatcttcaatatcatcttccgtactttgcactttcacgaaagttcctgcgtcgttaatcgcctgaaccgttgcagacaatacggtcgccaatacggcggttgccacggttgcggaggtgcgtttggtgtgggcgcgagtgagttcagacaccacaacccaagtttgagtcacaacattccaaataactttaaaaattttattcatttttatttaccctatatttaataacattaatagtgactacactttccttagtgaaagtgtgcgaattttattttatatttggagaataaaaaagtgatattttgcgaaaagtttagcctcaaaaaaaatagaaaaaacaaacagttacataaaaatcaaatctttttagataagttaatttattttttatttaaaataaggtttaggtttgtttatcttttatttctttttagcaagaaaaaagattaatcttgacccattttaggtgttttttgttgaaaagtgcggtaaaaattaaaagaaaaacctgctttctggcattgaaagcaggttttaggcaaaagggaacggcaatttattgaagtatttcgcccacaatactgcgtgtggcttctttcacttctgtgagtttcacttttaccatgtcgcctattttgtaagtgcgttcgccttttatatagagggcaagttcgtcagggtttagttgtatttcttctttgttgttgtgcagcgtggcggcaggaataaatagcgatgcaccattttcgagcagttgtacgcgtaagcctgcacgcattacatcttgcacttccgcctcaaattcagcatttgatgccactttgtcagcaagataacggcaatatagccaatcggcaatatcacgttctacgaggcgattttggcggcgagcctcttgcaaacgtgccaacacgtcattttgtggtttttcataaggctgttttgccagcacggctttgattaagcgatgattaaccatatctgaatatttgcggatgggcgatgtccaagtggcgtaaccctctagccccagcccaaagtgcggtgctaattctgatttaaattcggcgaaagttaaataacggcgtaaacgcagttctaaataatcgctttcgatgggttcaatatcgtggcgcatttggcaatagccgtttaaggttgctaagttttctactgaataacgttctgccagttcagtttgattttgttcattggctaaatttgccattaagaaattgtgtgcgttctctaagaattttttatcaaaaccgctatgggtgttgaaaatgcctgtttttgcctgtycgtgtaaaaattgggcggcgcagatgttggcaataatcattgcttcttccacaatttgattggcaatacggcgatattctgctttgatttcttgtactttgccgttttctgccagcacaaaggcataatcgggtttttctttaaagaataaggaatgggttttgcgccattgaatgcgagctttggtaaattgatgtagccagtgaatttgttgtgctgtttctggcatttctggctgccatgcattgtctgcctgttctaaataatccgacactttgttgtaagccagtttggctttagattgaacataagcggaaacaaaatgcggtttggctgtgatgttgcctgtaagatcggtttcgatataacagacaagcgcggggcgggtttcattggcgattaaggaacataattcatcagataattcacggggtaacattggaatgttaaagcccggtaaataatttgtgaagcaacgctgtttggcttcttgttctatttgagaatctaaggcgatgtaagcggttgggtcagcaatggcgaccactaatttccagcctgtttgtgtgctgttttgtgctatgggttcgatatataaggcgtcgtccatatccattgtgctttcggaatcaatggttacaaaatgaagtgcggtcagattttcgcgtgttttttgatctaacatttcataaggttctgcgcctcgcacgggatagcgcgattgttcgtggcgtgccaatgtgacccaccaaggggctaattcatcgtcagctcggcaaataagttgattaattgtggcgtagaaaaagcgatcgtcacgtaatggatgggtttttaaatttgcgacgacccagtcgccctcttgcaattcttcttttaccgatttcgcctgttgtgcgccaatgggttgattaatacttgggtgatccaccagcacttgtaatttcttgtctttattgaaccgcacttttgcgataaaacgtgtgagcattggctcaattaaggcttctggctcggcttgttctttgtcgccttgtttttcaatagtggctttgattttgtcgccatgcatcacttttttcattgatggcggtgcgatgaaataggtttttttatcgcactctaaaaaaccgtaggctttatctgtgctttttaccacgccctcaacctgttctttgctgtcgtggatttgttgtttaagttgtgcgagtagaggattatcttgaaacatagttattttgaaacatcgttattattttaaaaaagagaaaaggcagactgaaaagcctgcctaaaaaagaatgtaagaaaaattattcttcgcctaattcgcccattgcagtaatgctgaaacctgcatcaacgtgaacgatttcgccagtaatgccagaggctaagtcagagcataaaaatgccgctgagttacccacatcttcgatagtgacagtgcgacgtaatgcggcggttttttcaaaggtggaaagcattttcttgaagtttttaatgcctgatgcggctagggtgcggattgggcctgcagagattgcattcacacgaataccttctttgcctaaatctgctgccattacgcgtgttgcggcttcaagagaggcttttgctaggcacattacgttgtagttaggaattgcgcgctcagcacctaagtaagacaacgttaataatgcagcatttggatttaagtaaggacgtgccgcttgtgccattgccacgaagctgtatgcactaatatcgtgagcaatacggtagccttcacgagttgccgcatttacgtaatcgccgtctaattgatcacctggtgcaaatgcgattgcgtgaataaaaccatcaaatttatcccaacgcttacttaattctgcaaagcagttttggatgctttcatcggttgccacatctaaaggaagcacgatatcagaaccaaattctttggcaaattcttctacgcgcggttgtaatttatcgtttaaataagtgaaagcaagttctgcgccttgttctttcattgattttgcgatcccgtaagcaatggaacgattgcttgcaagacctgtgactaaaatgcgtttacctgttaagaaacccataatttttcctatgttgttagcgtaaaaaacttgcgtagtataagcgaaaatttgtctttgtacaaagccgaccaatatttctaagaaaaccaaccgcactttatttgcaaattcgtttgagcaaaaacctaaaatcagggaaaatagtccacatttttaattgaacaaagaagaaacaatgagttatccattagaagaagttaataaacgtcgcacttttgcgattatttcccaccctgatgcgggtaaaacaacgattactgaaaaagtacttttatacggcaatgcaattcaaactgcaggttctgtaaaaggcaaaggttcggcggctcacgcgaaatctgactggatggaaatggaaaaacaacgtgggatttcgattaccacttctgtgatgcaatttccttataatgattgtttagtgaatttgctcgatacccctggacacgaagatttctctgaagatacttaccgcactttaaccgctgtggatagctgtttgatggttattgactctgccaaaggggtggaggaacgtacgattaagttgatggaagtcacacgtttacgtgatacgcccattattacgtttatgaataaactcgaccgtgatattcgtgatccgatagaattgttggacgaggtggaaaatgtgttgaaaattcgttgtgcgccaattacttggccaattggctgtgggaagttgtttaagggcgtttatcatcttgcaaaagatgaaacctatttatatcaatcagggcagggttcaaccattcaggcagtgcgtgttgttaaaggcttgaataatcctgaattagatgttgctgttggcgatgatttagcacaacagcttcgtgaggaattggaattggtgcaaggcgcaagtaatgaatttgagcaagatgcctttattaagggcgagcttacccctgtatttttcgggacagcattaggcaattttggggtggatcattttcttgatggcttaacacaatgggctccgaaaccgcaatctcgtcaagcggatacaagaacggtggaaagtgcggaagaaaaattcagtggttttgtgtttaaaattcaagctaatatggatcccaaacaccgcgaccgtgttgcctttatgcgtgtggtttcgggcaaatatgaaaaaggcatgaaactaaaacatgttcgaattggtaaagatgtggtgatttctgacgcactcacctttatggctggcgaccgtgctcacgccgaagaagcttacgctggtgatattattggtttacataatcacggtacgattcaaattggcgatacgttcacgcaaggcgaaacgctgaaatttacaggcattccaaattttgcaccagagttgttccgtcgtattcgtttgaaagatccgcttaaacaaaaacaactgttaaaaggcttggtgcaactttctgaagagggtgcagtgcaagtgtttcgtccattattaaacaacgatttaattgtgggggctgtgggtgtgttgcagtttgatgtggtggtttcgcgtttaaaaactgaatataacgtggaagcgatttatgaaaatgtgaacgttgccacggctcgttgggtggaatgtgccgatgagaaaaaatttgaagaatttaaacgcaaaaatgagcaaaatttagccttagatggcggcgataatttaacctatatcgcgccaacaatggtaaatctaaatttagctcaagaacgttatcctgatgtcgttttttacaaaactcgcgaacattaaaatgacaaagtgcagtaaaattctaccgcacttttccagaaaaaaagcgttgaaatttaattcaacgcttttcttttatttagagagattttcttgttttaatcgccaaagttgataaatatttaccacaactaaaaaggcatttaataatgcaacagggtatgctgtgataattaggctgtaaataacaaataaaatcgcgccgatactatttacaatgcgtaaatgcacaatagatttaaataaaaaagatgcagcaacaaaaaaagtcgccatataacctaaaaactcaataaaattaaagtccattattttgttctctttgattaaaaataaaaacggtgggtatgataaaagatttttaacgcaaggmaaagataagaaaaagaagcaaccgtttgcaagggaaaattatataaaaataagttgaacaagagccatatagaaaagtgtgcctacggcaatagatagaaacatatttttcttccagaaatgtaagccaagcacgactatccctgcaagcaaatcaggaatgccgtgatagccagttaaaatctcaatatttttatagcaataaacgacaagcataccaaacattgcagggggtaaaacttttccaagataacggatatattgtggaatggggcgattaacaggaaatacaaaaaatggtaataaacgtgtaaattgtaccgccactatacaaattccgatggtaatgatttgttctattaatgtcattttaaagattccaattttgtttctaatttagttatgcgcatagttagaattaaccaaatgccaattaatgttggaattaaaaaatattcttttcctataataagtaaaaaaactaatgcgatgcctaaacctaatagagagctttcgtgggattttccttttaaccaattttctgcaaaaataactaagaatagtgctgtcattgaaaattccacaccttttaaattaaaaggtaaaacagtaccaaataaattccccattgctgcgccaagtacccaataaatatgcaaatataagctcacaaaaaacatataccagcctttatctaagtgcggtgggatttttgccatataatttagggaaaaagattcatctacaagtgttgtgattaaataccagcgtttttttcctatatgtatgccatatttttctagcattgatataccataaaaaatttggcgggcactaatcattaaggtaattaataatacgctgattggagagaaaggtgcaataagtgcgcctgctgcaataaattcaacagaacccgcataaataagtaaagccatcaaagtaggatataaaaatccgaaaccaagtgctttcatataaataccgtatgctatgccaagaaataaaaatcctgcaatcattggtacgctgtagggaaaagtagccttagccgcttcagtaattgggttagagtgttgattttgttgagataaattcattaattatgtctataaatttaaaacagaaagtccgggtaaagttgagaaactttgagatttgactgtttgataaaaatcttctaaataagaaagggattcatcttctttgcgaatcgccgcatatagattgctatataaaccttcttttgtgacttttcttgccacgacataacccttttccaaataaggcagcgcagcccaataagggatagtcgcaataccacgacgactcgcaacaagttgaatcattgcaatagtaagttctgttgtacggcgagtaggattaatgccttttgatttaagcactttacgccatagatctaacatatcgtcaggtacggggtaagttacccaagtttcatcaataaaatcttccgcttcccaaatatctttttctgctaaagaatgattttttgagcaaatcccaaccatttcataagaaaagagcggtttaaaaatgacatcatcattatgctctatttctgatactatcgcccaatctgctcgatgggaaagtaataaaccaacgggatcagtatgaaagccagatacaatatccagttctactagcccccaatgctgacggaattcatccatcgctggcattaaccaatcaaaacaagtatggcattccaccgctatacgtaactgtcctgcatcgccgtgttttacccgtgcaagatcacgttcagcatcaatcactttcggcattacttcattcgcaagacgaattaaacgctctcccgctgaagtaaaacgaagtggattacttttacgctcaaataaaggcaagccaaattgttcttctattaatttaatttggtgagaaagtgctgattgggttagatatacgcgctttgcagctagagaaacgctgcctgtctcttttaaagccaataaagttttaagatgtctaaattctagaaaggttggtttcattaataatattcatataaaattaagaattagggaaccagtataatacattaaaattagaaatatgctaattaataaaattaattatttagataattattttagttaaaatacaaaaccccagtccttaaactggggttctatatttattctttatctaatttgtttaattctgtttttacttaacttaatttaattttatctatcttagatagatttatatttagattttttatttgataacctggcggtgccctactctcacatggggaaaccccacactaccatcggcattacagcgtttcacttctgagttcggtatggtctcaggtgggtccaccgcactatcgccgccaggataattctttgataactcgtcttttctcttttatctctcgtctcttttatctctcgttactcagtctttcctctacctttcactcgttcttattggtcacaagctgaatccgattttctttctattaagtcttctatatttacttttctttgtttagtcttttacttctctttcgctctgcttttatttgcttcgcttttcatctcttacttcacttagctcccaaaaacacttgagcgttgtatagttaagcctctcgggcaattagtattggttagctcaatgactcacatcacttacacacccaacctatctacgtcgtagtctacaacaacccttactgacttaaagtcagggatgactcatctcttggcaagtttcgtgcttagatgctttcagcactttatctcttccgcatttagctacccggcaatgcgtctggcgacacaaccggaacaccagtgatgcgtccactccggtcctctcgtactaggagcagccccaatcaatcatcctacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctctttcgatgacaccatcaattaaccttccagcaccgggcaggcatcacaccctatacgtccactttcgtgtttgcagagtgctgtgtttttaataaacagttgcagccagctggtatcttcgaccggttcaaccttcaggggctagcccttacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagcccacctctcgatgaaccttcttccgcttacacaacgctcccctacccaacagaataaattctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaagccgggatggccccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactattcgcccagttaagactcggtttcccttcggctcccctattcggttaacctcgctacaaaatataagtcgctgacccattatacaaaaggtacgcagtcacaaggttgccctcgctcccactgcttgtacgtacaaggtttcaggttctatttcactcccctcaccggggttcttttcgcctttccttcacagtactggttcactatcggtcaatcaggagtatttagccttggaggatgggccccccttcttcaaacaggatatcacgtgtcccgccctacttctcgttagcttagtaccacaatatggtttttagatacgggattatcaccctctttgattgtgcttcccaacacattctcctcactatattgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtattttcattcaactaaacacttgattgcttttgttcaatcaagatttttttacaaaacaggttttgtttttagagtttccttttcagttctctctttcactttactgttttgcctactcagactttctctcgaaaatctcttgttttcagcttgtttccaattttttaaagaacagttgataaaacttttcagttatcatcgttaaataaactaaaacaaaattaaatttaaaattaaacttaaaactaagaataaaataacctaatatttaaaatagcttaatcactaccttaatactttattaatttgtctttttctaatttacttaacaatgataagtggtggagataagcgggatcgaaccgctgacctcctgcgtgcaaggcaggcgctctcccagctgagctatatccccatttcatcataatttaataactaatcatttatgtcttagttattatttatttacactacacctttcgtttcactcactctcagagtggtgggtctgagtggacttgaaccaccgacctcacccttatcaggggtgcgctctaaccacctgagctacagacccaagggtaatgttttcttctgctcatttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcctaggttaagcccagggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtactattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactgcttagctataaataaaatactacttaaaaaagtaataatgaattttcagttaagcacctattaagacttcaaaattaaaaatagttttaaaacaagtcaatcaacaagtgcccacacagattgtctgatatattgttaaagagcaaaaaataacgacgcacttggaaacttaaaaaacttcacaacagtgcgtcgttgtgtgcggtgcattatagggattttcaaatcccttgcaagtactttttgcaaaaatttttgaaaaactcgaccgtttgttgaaaatacatacgtaaaatacataattccgccaacaaatggttgatttttgatctcaatttataaattaaagtttacttagatcaaccaaagcctctggtttaatatcggcaatagtacgattgctggttaatgtcatcgctacgtgcatctcttttttgaaaatgtcgagcatattttcaacaccttgacgaccttctgcccctaaagcataaacaaatgctcgacctaacattgttgcatctgcccctaatgccaacatacggactatgtctaaaccattgcgaatacctgaatcggcaataattttaatatcccctttcactgcatcggcaattggtggcaacgctcttgcacttgaaagcacgccatctaactgacggccaccgtgatttgaaacaacaattccatcagcaccgaaacgcaccgcatctttcgcatcttcagggtcgagaatacctttaatgaccattggaccttcccaaaactcacggatccactctaaatctttccacgaaattgatggatcaaagttttctgttagccagccaatatagtcatctaaacctatttgtctacccatataagttgaaacattacccaaggtgtgcggtttgcctttgatacccacatcatacgcccagaatgggtgtgtaaagccttgtaatacacggcgaatttctttgtaaggcccgctcatacctgagtgcatatcacgataacgtgcacctggagtaggcatatcgaccgtaaacactaaagtagaacagcctgctgctttcgcacgctcaagcgcgtttttcataaaaccacgatcttttaacacataaagctgaaaccacattggacgcttaatcgcaggggcgacttcttcaattggacaaattgatactgttgaaagggtaaacggcacacctttattgtccgccgcttgtgctgcttgtacttctccacgacgcgcatacattccgcacgccccaactggtgcaagaatagttggcattgaaagtttttcaccaaataattctatactagtatccaattcagacatatcttttaagacacgttgtcttaaagcaatattttccaaatcactcacattacgcgcaagtgtttgctcggcataagaaccgccatcggcataatggaacataaagggaggaacacggcgacgcgccgcttcacgataatcgctagctgatgaaataatcatttttacctcttattcaataaaatagtgagaaacctgagaggtattataacactattttaacaaattcaataaaaatcataattattttgagaactagatcacaatttattttaaaaaagtgacatatagaaatgatataagtagaaaaatcacctataaaattaggaaaaattgtgaatttatcaatatcacacaattaatctattaacttttaatctattttgattacttccaaagattcaaatccccatagatgtaaagcttttttaaattgagattcttcgggaaaatgtgcggtgcaaaacatttgattatatttttcattttgcgcttgtagatttttatcatcaagtaaatatttgatccgtttagcaattgctgcgctcggttccataaaatatttaacttgtggcaagcataactgaatttcatctttgatgagaggaaagtgagtacaacctaaaactaatgtatccaaatctgccatgcctgcccacgaagataactcatcttttaaactaatgagatcaacggaatgaccacgaattttttgctccgcaatttcgactaattttgtcgttcccagtctctcaacaatacaatcttgcgcaaatttatcaatcaactcatcgatataatgacgttttacagtcccctttgtagctaataaaccaatatgttttgtctttgttatttctgatgcaggtttaatagcgggtacagtcccaatgataggaatatcaaaagcagctcgcaaaggcggaagcacaacagtactcgctgtattgcaagctatcaccattgcatctaatggataacgttgattaataagctgacacgccgctaaagttcggtgaataatactttcttctttgcgttctgaataagggaatcccgcattatcaaagcaatagagataatgccaattgggtaatagttttttggcttcacggatatacgctaaacccacccactccagaatcaaaaaagagcactgttgggcgtttttcttttttatccatttaaaactctttgaaaattgaccgcacttttaagcgttcgagtaaatttctttattattgagccagcgacggattaggctttctgccacatcagggtatttttggataagtgatttcgcataatgttgcaccgttggtatcattttnctatctcgcattaaatttgctactcgcaattcagcaattcccgtttgtttcgttccaagtacttcacctggcccacgaatttctaaatctttttccgaaataacaaacccatcttggctatctcgtagcacctgcaagcgtttttgtgaaactttacctagcggaggtttatacattagtacacaaaaagaagccgtgcagcctcgaccgacgcgccctcgtaactgatgaagctgcgataaacctaaacgttctgcattttcgataatcatcaaactcgcattcggaacatcaacacccacttcgatgactgtcgttgccaccaataaatccaattctgcatttttaaaacgcatcatgacatcttgtttttcttggggtttcatgcgcccgtgcactaaaccaatatttaacatcggtaacgctttcgttaaatcttcccaaatcgcttcagctgcttgagcttctaacacctctgattcatcaattaacgtacacacccaataggcttgacgtttttcattaacacaagcgttttttacacgcatcacaatttcagctcgacgttcttcagaaaccactacggttgttatcggcgtacgacctggaggcaattcatcaataattgatgtatccaaatctgcatatacggtcattgccaacgttctcggaatcggcgtggccgtcataattaactgatggggataaaatcccgctttttcgcctttttcacgcaacattaatcgttgatgcaccccaaaacgatgttgttcatcaataatcactaatgctaagtcggaaaactcgacttcttcttggaataaagcatgcgtccccaccaccatttgcaccgcgccagttttgattttttcaagctctgcttgtcttgattttccttttactttacctgccaaccagccaacttcaataccgaaaggcttaaaccaccgtctaaaattattcgcatgctgttctgcaagaatttctgttggcgccattaaggcgacttgtttgccattatcaattgcagttaaagcagccaatgcggcaaccaatgtttttcccgagcccacatcgccttgcactaagcgcatcatcggataatctttgataagatcttgttcaatatcggacactactcgcttttgcgcattagtgggttgaaatggcaaggtggctaaaaatcgctgtttcaaatctgtttgataatgtagcggtaaggcagaaaattgttgcgttcctaaccgcactttttgcatagctaaattatgtgccagaagctcttcaaaaattaatcgttgttgtgcaggatgcttaccttgctctaacatttctaatgaaatatctggcggcggacgatgcaataatcgcaatgcctcttttaagctatattgatgtggattaaattcattaggcaaaatttctgcaatctgaactttgtcgagtaatgccaaagcctgatccgttaattttcgtaatgaattttgttttagcccttccgttgtggaataaatcggcgttagggtttcttccaatactatgggcgcattatctcgcacaatttgatattctggatgatgaatttctggcatgtgacgcccacgtttcacttcgccaaaagcctttactcgcacgccaacttgaaaactattacgcattcccgcattaaaattgaaaaaacgtaacataattttcgatgtgccgtctgacaaacttaccgataaaatcgggcgacggccaaaagcgacttcacaggtttgtacaattccttcaatggtaaaatattgttcggggcggagattagcgattagcgtaattcgcgtacgatcttcatagcgaataggtaaatgaaagagtaaatcttgcagattatgaatgccgattttagccagtttattagaaatggcagcccccacaccagaaaggctggtcaaaggcacggcatcgagaagttcaaggctcatagctcattaatattgcgtttgacattaacgacgccagtgatgcctttaatacgatgaacgatattggcaaggtgtttgatatcttttacacaaacctgcaaaatcacaagcaataaattgttctctaattcttccgtccaaatattttggagactgctttcgctcgctgaaattgcggtcattaaactaagcaaggcattctgctcattcaatatttctatttgtaattcagcctcaaaattcaccgcactttgaacgttatcccacttagccaacgattgacgacaagcatttttcaaacttgcacaatgttgatggtgtaccacaactgtatttttttctgtacaacatcccacaataggatcacctaggattggatggcaacattgagcaaattgtgttttacccacttgcattggtgcaatagtgagtatttttgattcaaattcgagattcttagtattagcagattctaacggcacgcccacaaattgatgcgcaatcatggaggctgactgattacctaaaccaatttctcgtaataattcatctaaagaagaaagggctaaagcatctaatacagttctaatttgttgaatagaaaaatcacctaaattatgcggctgtaatgctacattaagctcaacttcgcctaatttcaccgcatcctcttcacaacgctgtttgagataatggcgaatccgtgttttcgcacgagccgttaccacaaaatttaaccatgcgacttcaggatgcgcatttggatcagtaatgatattgactgtttgccctgattcaagggcttttgaaagtggataaggtttatgctcaacggttacgccaacacaagtattccccacatctgaatgcacagcataagcaaaatctactgctgttgcgcccattggcaattcaacaattcgaccttttggcgtaaaaacataaatttctttcgggaaaaactctgattttacattctcaataaactcaaacgaattacctacactttgttgaatttcaaccaaactttgcaaccagcgttgtactcggatttgtgcggttgtactgtcgtttttaccattttctttataaacccaatgcgcagtaatgcccatttcagcgacttgttccatatcctcagtatggatatgaacttctacgggaacacctttcggcccaatcattgaagtttgcaaagattgatagccatttgctttaggtaccgcgatataatccttaactcggcctggacgtggcttataaagattatgcatttgccccaaaacgcgataacaatcatcaacatttttcacaatcacacggaacgcataaatatccataatagagtggaattcttgatcctttatgcgcattttttgatagatcttgtaaagatgtttttcacgtccccacactcgggcaaaaatgcctgagttttctaaccgcactttaatctcttgtgaaatacgttcgattaaatcttgtcgattactccgcgccacatcaacgagtttttttaacacctcataacgatgtggatgcattgcttgaaaagataagtcttctaattcatttttgatatgctcaatacctaaacgatgagcaagcggacaatagatttcaagcgtttctttcgcaatacggcgacgtttatctggtcgtaacgaaccaagcgtgcgcatattatgcgtgcggtcagcaagcttgattaacacaacgcgaatatcacgcgtcatcgccaaaatcattttgcgaaaattctcgacttgtgcttcttggcgagtacgaaatttcaacttatcgagttttgatacaccgtccacaatttcagccacactggcaccgaactcttctttcagttgttcttccgtataaggtgtatcttcaataacatcgtgcaaaagcgcagccattaccgcttcgtgatctaagtgaagttgagcaataatggaggctaccgccacaggatgggtaatgtaaggttcgccgctggagcgaaattgtccttcgtgcgcatctcttgcaatcacaaacgcacgcttgatgagttcaattttatctgcgggcaaatacccttgaataattcgatctaaatccgcaaacagttccaaaggagacctacttatcgttgaaaaatatcgcctagggtaagtagaccctagcttaactaaatgttaccctttggggtagaaattacgttccccaaagggggacaactataaccataattaaccgtgggtatacctacccgcggtaaaatacctttattttttaccgcacttttaaaagattattctgtaattaatgcaacagctgcttcttccgtttcttgcactttcgccattttttggaantcttgtgcatccataatatcttgattaatcaaacctttttcgatttcacgtaatgcgattactgttggtttgtcattatcttctggcactaatggtgcactttgattaagttgtaattgtcttgcacgacgtgcagccgttaaaattaaatcaaaacggttaccaattttttctactgcatcttgcacagtaacacgagccataatttactccgatttgtcaaaaattactctattgaaagggcgttataatactcaatttcgccctattttgctagtagctgttgaattaacattgcattttgtttttgttgataatctttagttaagcgttccgattgcaaaatactttgtaaatcttttaatgttttctcaaaatcatcattcacaatgacataatcatattcgtcataatgcgaaatttcactcatcgcttttgacattcgttcagcgataacctcttcactatcttgccctcgaccaattaaacgacgctctaattcaggcaatgaaggcggtaaaataaaaatgctttttactgaaggcacttttttacggatttgttgggcgccctgccaatcaatatctaaaaatacatcaatgccttttgctaaattttcctcaatcgcaggtaaagaggttccataataattgccaccaaaaactttggcatattctagaaataaatcttgctcaatgagtgattcaaactcttcttttgatacaaaataatagtgtacgccttcaacttcacccgggcgtggggcacgggtcgtatgtgacacagaaaccattttttgagttgagctatctgatgccaataacgctgaaattaatgaagattttcctgcgccacttggtgcagataaaatataaagattaccttgagacatagaatatttaaccttctctgacaatttcagtctattatgcagatttctctataaaaaatcatcaaaagtgcggtgattttttwcggtactttttcattctaatgatgatttgatatagatcacaaaaaagtagtagggtttatagttttataaaaatgctcgtgctatactctgtgcgttgtcttactgagtgagcagtattactcaaagcaaacagatttgtttaacttaaataaaaggtgaaaatcttatggcaattaaaattggtatcaatggttttggtcgtatcggccgtatcgtattccgtgcagcacaacaccgtgatgacattgaagttgtaggtattaacgacttaatcgacgttgaatacatggcttatatgttgaaatatgattcaactcacggtcgtttcgacggcactgttgaagtgaaagatggtaacttagtggttaatggtaaaactatccgtgtaactgcagaacgtgatccagcaaacttaaactggggtgcaatcggtgttgatatcgctgttgaagcgactggtttattcttaactgatgaaactgctcgtaaacatatcactgcaggcgcaaaaaaagttgtattaactggcccatctaaagatgcaacccctatgttcgttcgtggtgtaaacttcaacgcatacgcaggtcaagatatcgtttctaacgcatcttgtacaacaaactgtttagctcctttagcacgtgttgttcatgaaactttcggtatcaaagatggtttaatgaccactgttcacgcaacgactgcaactcaaaaaactgtggatggtccatcagctaaagactggcgcggc

What is claimed is:

1. An isolated polynucleotide fragment comprising a nucleic acid sequence encoding an amino acid sequence encoded by an ORF selected from the group consisting of:
   (a) HI0140, represented by nucleotides 153446–154522 of SEQ ID NO:1;
   (b) HI1585, represented by nucleotides 1647247–1647711 of SEQ ID NO:1;
   (c) HI1167, represented by nucleotides 1234699–1235757 of SEQ ID NO:1;
   (d) HI0714, represented by nucleotides 757488–760739 of SEQ ID NO:1;
   (e) HI0403, represented by nucleotides 421547–422923 of SEQ ID NO:1;
   (f) HI1545, represented by nucleotides 1609845–1610543 of SEQ ID NO:1;
   (g) HI1545, represented by nucleotides 1611384–1613228 of SEQ ID NO:1;
   (h) HI1688, represented by nucleotides 1751031–1752089 of SEQ ID NO:1; and
   (i) HI0918, represented by nucleotides 970249–970839 of SEQ ID NO:1.

2. The isolated polynucleotide of claim 1, wherein said ORF is (a).

3. The isolated polynucleotide of claim 2, wherein said nucleic acid sequence is identical to the nucleic acid sequence of HI0140.

4. The isolated polynucleotide of claim 1, wherein said ORF is (b).

5. The isolated polynucleotide of claim 4, wherein said nucleic acid sequence is identical to the nucleic acid sequence of HI1585.

6. The isolated polynucleotide of claim 1, wherein said ORF is (c).

7. The isolated polynucleotide of claim 6, wherein said nucleic acid sequence is identical to the nucleic acid sequence of HI1167.

8. The isolated polynucleotide of claim 1, wherein said ORF is (d).

9. The isolated polynucleotide of claim 8, wherein said nucleic acid sequence is identical to the nucleic acid sequence of HI0714.

10. The isolated polynucleotide of claim 1, wherein said ORF is (e).

11. The isolated polynucleotide of claim 10, wherein said nucleic acid sequence is identical to the nucleic acid sequence of HI0403.

12. The isolated polynucleotide of claim 11, wherein said ORF is (f).

13. The isolated polynucleotide of claim 12, wherein said nucleic acid sequence is identical to the nucleic acid sequence of HI1545.

14. The isolated polynucleotide of claim 11, wherein said ORF is (g).

15. The isolated polynucleotide of claim 14, wherein said nucleic acid sequence is identical to the nucleic acid sequence of HI1547.

16. The isolated polynucleotide of claim 11, wherein said ORF is (h).

17. The isolated polynucleotide of claim 16, wherein said nucleic acid sequence is identical to the nucleic acid sequence of HI1688.

18. The isolated polynucleotide of claim 1, wherein said ORF is (i).

19. The isolated polynucleotide of claim 18, wherein said nucleic acid sequence is identical to the nucleic acid sequence of HI0918.

20. The isolated polynucleotide of claim 14, wherein said polynucleotide comprises a heterologous polynucleotide sequence.

21. The isolated polynucleotide of claim 20, wherein said heterologous polynucleotide sequence encodes a heterologous polypeptide.

22. A method for making a recombinant vector comprising inserting the isolated polynucleotide of claim 1 into a vector.

23. A nucleic acid sequence complimentary to the polynucleotide of claim 1.

24. A recombinant vector comprising the isolated polynucleotide of claim 1.

25. The recombinant vector of claim 24, wherein said polynucleotide is operably associated with a heterologous regulatory sequence that controls gene expression.

26. A recombinant host cell comprising the isolated polynucleotide of claim 1.

27. The recombinant host cell of claim 26, wherein said polynucleotide is operably associated with a heterologous regulatory sequence that controls gene expression.

28. A method for producing a polypeptide, comprising:
   (a) culturing a host cell under conditions suitable to produce a polypeptide encoded by the polynucleotide of claim 1, and
   (b) recovering the polypeptide from the cell culture.

29. An isolated polynucleotide comprising a nucleic acid sequence encoding at least 15 contiguous amino acid residues of an amino acid sequence encoded by an ORF selected from the group consisting of:
   (a) HI0714, represented by nucleotides 757488–760739 of SEQ ID NO:1; and
   (b) HI1688, represented by nucleotides 1751031–1752089 of SEQ ID NO:1.

30. The isolated polynucleotide of claim 29, wherein said ORF is (a).

31. The isolated polynucleotide of claim 29, wherein said ORF is (b).

32. An isolated polynucleotide complementary to the polynucleotide of claim 29.

33. The isolated polynucleotide of claim 29, wherein said polynucleotide comprises a heterologous polynucleotide sequence.

34. The isolated polynucleotide of claim 33, wherein said heterologous polynucleotide sequence encodes a heterologous polypeptide.

35. A method for making a recombinant vector comprising inserting the isolated polynucleotide of claim 29 into a vector.

36. A recombinant vector comprising the isolated polynucleotide of claim 29.

37. The recombinant vector of claim 36, wherein said polynucleotide is operably associated with a heterologous regulatory sequence that controls gene expression.

38. A recombinant host cell comprising the isolated polynucleotide of claim 29.

39. The recombinant host cell of claim 38, wherein said polynucleotide is operably associated with a heterologous regulatory sequence that controls gene expression.

40. A method for producing a polypeptide, comprising:
   (a) culturing a host cell under conditions suitable to produce a polypeptide encoded by the polynucleotide of claim 29; and
   (b) recovering the polypeptide from the cell culture.

41. The isolated polynucleotide of claim 29, wherein said polynucleotide comprises a nucleic acid sequence encoding at least 30 contiguous amino acid residues of an amino acid sequence encoded by an ORF selected from the group consisting of:
- (a) HI0714, represented by nucleotides 757488–760739 of SEQ ID NO:1; and
- (b) HI1688, represented by nucleotides 1751031–1752089 of SEQ ID NO:1.

42. The isolated polynucleotide of claim 41, wherein said ORF is (a).

43. The isolated polynucleotide of claim 41, wherein said ORF is (b).

44. An isolated polynucleotide complementary to the polynucleotide of claim 41.

45. The isolated polynucleotide of claim 41, wherein said polynucleotide comprises a heterologous polynucleotide sequence.

46. The isolated polynucleotide of claim 45, wherein said heterologous polynucleotide sequence encodes a heterologous polypeptide.

47. A method for making a recombinant vector comprising inserting the isolated polynucleotide of claim 41, into a vector.

48. A recombinant vector comprising the isolated polynucleotide of claim 41.

49. The recombinant vector of claim 48, wherein said polynucleotide is operably associated with a heterologous regulatory sequence that controls gene expression.

50. A recombinant host cell comprising the isolated polynucleotide of claim 41.

51. The recombinant host cell of claim 50, wherein said polynucleotide is operably associated with a heterologous regulatory sequence that controls gene expression.

52. A method for producing a polypeptide, comprising:
- (a) culturing a host cell under conditions suitable to produce a polypeptide encoded by the polynucleotide of claim 41; and
- (b) recovering the polypeptide from the cell culture.

53. An isolated polynucleotide fragment comprising a nucleic acid sequence which hybridizes under hybridization conditions, comprising hybridization in 5× SSPC and 50% formamide at 50–65° C. and washing in a wash buffer consisting of 0.5× SSPC at 50–60° C., to the complementary strand of an ORF selected from the group consisting of:
- (a) HI0714, represented by nucleotides 757488–760739 of SEQ ID NO:1; and
- (b) HI1688, represented by nucleotides 1751031–1752089 of SEQ ID NO:1.

54. The isolated polynucleotide of claim 53, wherein said ORF is (a).

55. The isolated polynucleotide of claim 53, wherein said ORF is (b).

56. An isolated polynucleotide complementary to the polynucleotide of claim 53.

57. The isolated polynucleotide of claim 53, wherein said polynucleotide comprises a heterologous polynucleotide sequence.

58. The isolated polynucleotide of claim 57, wherein said heterologous polynucleotide sequence encodes a heterologous polypeptide.

59. A method for making a recombinant vector comprising inserting the isolated polynucleotide of claim 53 into a vector.

60. A recombinant vector comprising the isolated polynucleotide of claim 53.

61. The recombinant vector of claim 60, wherein said polynucleotide is operably associated with a heterologous regulatory sequence that controls gene expression.

62. A recombinant host cell comprising the isolated polynucleotide of claim 53.

63. The recombinant host cell of claim 62, wherein said polynucleotide is operably associated with a heterologous regulatory sequence that controls gene expression.

64. A method for producing a polypeptide, comprising:
- (a) culturing a host cell under conditions suitable to produce a polypeptide encoded by the polynucleotide of claim 53; and
- (b) recovering the polypeptide from the cell culture.

65. An isolated polynucleotide comprising at least 50 contiguous nucleotides of an ORF selected from the group consisting of:
- (a) HI0714, represented by nucleotides 757488–760739 of SEQ ID NO:1; and
- (b) HI1688, represented by nucleotides 1751031–1752089 of SEQ ID NO:1.

66. The isolated polynucleotide of claim 65, wherein said ORF is (a).

67. The isolated polynucleotide of claim 65, wherein said ORF is (b).

68. An isolated polynucleotide complementary to the polynucleotide of claim 65.

69. The isolated polynucleotide of claim 65, wherein said polynucleotide comprises a heterologous polynucleotide sequence.

70. The isolated polynucleotide of claim 69, wherein said heterologous polynucleotide sequence encodes a heterologous polypeptide.

71. A method for making a recombinant vector comprising inserting the isolated polynucleotide of claim 65 into a vector.

72. A recombinant vector comprising the isolated polynucleotide of claim 65.

73. The recombinant vector of claim 72, wherein said polynucleotide is operably associated with a heterologous regulatory sequence that controls gene expression.

74. A recombinant host cell comprising the isolated polynucleotide of claim 65.

75. The recombinant host cell of claim 74, wherein said polynucleotide is operably associated with a heterologous regulatory sequence that controls gene expression.

76. A method for producing a polypeptide, comprising:
- (a) culturing a host cell under conditions suitable to produce a polypeptide encoded by the polynucleotide of claim 65; and
- (b) recovering the polypeptide from the cell culture.

77. An isolated polynucleotide comprising at least 100 contiguous nucleotides of an ORF selected from the group consisting of:
- (a) HI0714, represented by nucleotides 757488–760739 of SEQ ID NO:1; and
- (b) HI1688, represented by nucleotides 1751031–1752089 of SEQ ID NO:1.

78. The isolated polynucleotide of claim 77, wherein said ORF is (a).

79. The isolated polynucleotide of claim 77, wherein said ORF is (b).

80. An isolated polynucleotide complementary to the polynucleotide of claim 77.

81. The isolated polynucleotide of claim 77, wherein said polynucleotide is a heterologous polynucleotide sequence.

82. The isolated polynucleotide of claim 81, wherein said heterologous polynucleotide encodes a heterologous polypeptide.

83. A method for making a recombinant vector comprising inserting the isolated polynucleotide of claim 77, into a vector.

84. A recombinant vector comprising the isolated polynucleotide of claim 77.

85. The recombinant vector of claim 84, wherein said polynucleotide is operably associated with a heterologous regulatory sequence that controls gene expression.

86. A recombinant host cell comprising the isolated polynucleotide of claim 77.

87. The recombinant host cell of claim 86, wherein said polynucleotide is operably associated with a heterologous regulatory sequence that controls gene expression.

88. A method for producing a polypeptide, comprising:
(a) culturing a host cell under conditions suitable to produce a polypeptide encoded by the polynucleotide of claim 77; and
(b) recovering the polypeptide from the cell culture.

* * * * *